US010772972B2

(12) United States Patent
Rudge et al.

(10) Patent No.: US 10,772,972 B2
(45) Date of Patent: Sep. 15, 2020

(54) ANTI-STEAP2 ANTIBODY DRUG CONJUGATES, AND COMPOSITIONS AND USES THEREOF

(71) Applicant: Regeneron Pharmaceuticals, Inc., Tarrytown, NY (US)

(72) Inventors: John Rudge, Mahopac, NY (US); Frank Delfino, Poughquag, NY (US); Laurie Haber, Rye Brook, NY (US); Eric Smith, New York, NY (US); Jessica R. Kirshner, New York, NY (US); Alison Crawford, Dobbs Ferry, NY (US); Thomas Nittoli, Pearl River, NY (US)

(73) Assignee: Regeneron Pharmaceuticals, Inc., Tarrytown, NY (US)

( * ) Notice: Subject to any disclaimer, the term of this patent is extended or adjusted under 35 U.S.C. 154(b) by 286 days.

(21) Appl. No.: 15/713,569

(22) Filed: Sep. 22, 2017

(65) Prior Publication Data

US 2018/0104357 A1    Apr. 19, 2018

Related U.S. Application Data

(60) Provisional application No. 62/399,256, filed on Sep. 23, 2016.

(51) Int. Cl.
*A61K 47/68* (2017.01)
*C07K 16/28* (2006.01)
(Continued)

(52) U.S. Cl.
CPC ...... *A61K 47/6871* (2017.08); *A61K 47/6803* (2017.08); *A61K 47/6869* (2017.08);
(Continued)

(58) Field of Classification Search
None
See application file for complete search history.

(56) References Cited

U.S. PATENT DOCUMENTS

| 2006/0052321 | A1* | 3/2006 | Raitano | C07K 14/47 |
| | | | | 514/44 R |
| 2012/0087862 | A1* | 4/2012 | Hood | G01N 33/6845 |
| | | | | 424/9.1 |
| 2013/0029900 | A1* | 1/2013 | Widdison | A61K 47/6863 |
| | | | | 514/2.3 |

FOREIGN PATENT DOCUMENTS

| WO | 02/026822 A2 | 4/2002 |
| WO | 03/087306 A2 | 10/2003 |
| WO | 05/079490 A2 | 1/2005 |

OTHER PUBLICATIONS

Jain et al., Pharm Res (2015) 32:3526-3540 (Year: 2015).*
(Continued)

*Primary Examiner* — Karl J Puttlitz
(74) *Attorney, Agent, or Firm* — Schwabe, Williamson & Wyatt PC; Robert Chang

(57) ABSTRACT

The protein known as six-transmembrane epithelial antigen of prostate 2 (STEAP2) is highly expressed in prostate cancer and is associated with the expression of other prostate cancer-associated genes. The present invention provides novel full-length human IgG antibodies that bind to human STEAP2 (monospecific antibodies). The present invention also provides novel bispecific antibodies (bsAbs) that bind to both STEAP2 and CD3 and activate T cells via the CD3 complex in the presence of STEAP2-expressing tumors. According to certain embodiments, the present invention provides bispecific antigen-binding molecules comprising a first antigen-binding domain that specifically binds human and monkey CD3, and a second antigen-binding molecule that specifically binds human STEAP2. In certain embodi-
(Continued)

H1H7814N-7 efficacy on C4-2 tumors in SCID mice

- Vehicle-PBS
- Control ADC -7    40 mg/kg
- H1H7814N-7    10mg/kg
- H1H7814N-7    20mg/kg
- H1H7814N-7    40mg/kg ments, the bispecific antigen-binding molecules of the present invention are capable of inhibiting the growth of tumors expressing STEAP2. The bispecific antigen-binding molecules of the invention are useful for the treatment of prostate diseases and disorders in which an upregulated or induced STEAP2-targeted immune response is desired and/or therapeutically beneficial. For example, the bispecific antibodies of the invention are useful for the treatment of prostate cancers, including castrate-resistant prostate cancer. The present invention also includes anti-STEAP2 antibody drug conjugates which inhibit tumor growth in vivo.

41 Claims, 12 Drawing Sheets

Specification includes a Sequence Listing.

(51) Int. Cl.
  *C07K 16/30* (2006.01)
  *A61P 35/00* (2006.01)
  *C07K 16/40* (2006.01)
  *C07K 16/46* (2006.01)
  *A61K 39/00* (2006.01)
(52) U.S. Cl.
  CPC .......... *A61P 35/00* (2018.01); *C07K 16/2809* (2013.01); *C07K 16/3069* (2013.01); *C07K 16/40* (2013.01); *C07K 16/468* (2013.01); *A61K 2039/505* (2013.01); *C07K 2317/21* (2013.01); *C07K 2317/24* (2013.01); *C07K 2317/31* (2013.01); *C07K 2317/33* (2013.01); *C07K 2317/565* (2013.01); *C07K 2317/77* (2013.01); *C07K 2317/92* (2013.01)

(56) References Cited

OTHER PUBLICATIONS

WIPO Application No. PCT/US2017/053111, PCT Invitation to Pay Additional Fees and, where applicable, Protest Fee dated Dec. 8, 2017.
Sikkeland et al., "STAMPing at the crossroads of normal physiology and disease states," Molecular and Cellular Endocrinology, vol. 425, pp. 26-36; (2016).
Vaghjiani et al., "Six-Transmembrane Epithelial Antigen of the Prostate (STEAP1 and STEAP2)—Differentially Expressed by Murine and Human Mesenchymal Stem Cells," Tissue Engineering, vol. 15 (No. 8); DOI: 10.1089 (2009).
WIPO Application No. PCT/US2017/053111, PCT International Search Report and Written Opinion of the International Searching Authority dated Feb. 26, 2018.
Whiteland et al., "A Role for STEAP2 in Prostate Cancer Progression," Clin Exp Metastasis, vol. 31:909-920, (2014); DOI 10.1007/s10585-014-9679-9.

* cited by examiner

ANTI-STEAP2 ANTIBODY DRUG CONJUGATES, AND COMPOSITIONS AND USES THEREOF

CROSS-REFERENCE TO RELATED APPLICATION

This Application claims the benefit under 35 USC § 119(e) of U.S. Provisional Patent Application No. 62/399,256, filed Sep. 23, 2016, which is herein incorporated by reference in its entirety.

REFERENCE TO A SEQUENCE LISTING

This application incorporates by reference the Sequence Listing submitted in Computer Readable Form as file 10296US01-Sequence.txt, created on Sep. 22, 2017 and containing 739,964 bytes.

FIELD OF THE INVENTION

The present invention relates to antibodies, and antigen-binding fragments thereof, which are specific for six-transmembrane epithelial antigen of prostate 2 (STEAP2), and methods of use thereof. The present invention also relates to bispecific antigen-binding molecules that bind STEAP2 and CD3, and methods of use thereof. The present invention further relates to antibody-drug conjugates comprising an anti-STEAP2 antibody or fragment thereof and a therapeutic agent (e.g., a cytotoxic agent).

BACKGROUND

Six-transmembrane epithelial antigen of prostate 2 (STEAP2), also known as STEAP-2, metalloreductase STEAP2, prostate cancer-associated protein 1, protein up-regulated in metastatic prostate cancer, SixTransMembrane protein of prostate 1 (STAMP1), and 098P4B6, is an integral, six-transmembrane-spanning protein, which is upregulated in normal and malignant prostate cells. STEAP2, which works as a shuttle between the Golgi complex and the plasma membrane, is a metalloreductase which reduces iron and copper, facilitating their import into the cell. STEAP2 is mainly localized to epithelial cells of the prostate. STEAP2 is also expressed in normal heart, brain, pancreas, ovary, skeletal muscle, mammary gland, testis, uterus, kidney, lung, trachea, colon, and liver. STEAP2 is over-expressed in cancerous tissues, including prostate, bladder, cervix, lung, colon, kidney, breast, pancreatic, stomach, uterus, and ovarian tumors (Gomes, I. M. et al., 2012, Mol. Cancer Res. 10:573-587; Challita-Eid—P. M., et al., 2003, WO 03/087306; Emtage, P. C. R., 2005, WO 2005/079490).

CD3 is a homodimeric or heterodimeric antigen expressed on T cells in association with the T cell receptor complex (TCR) and is required for T cell activation. Functional CD3 is formed from the dimeric association of two of four different chains: epsilon, zeta, delta and gamma. The CD3 dimeric arrangements include gamma/epsilon, delta/epsilon and zeta/zeta. Antibodies against CD3 have been shown to cluster CD3 on T cells, thereby causing T cell activation in a manner similar to the engagement of the TCR by peptide-loaded MHC molecules. Thus, anti-CD3 antibodies have been proposed for therapeutic purposes involving the activation of T cells. In addition, bispecific antibodies that are capable of binding CD3 and a target antigen have been proposed for therapeutic uses involving targeting T cell immune responses to tissues and cells expressing the target antigen.

Antigen-binding molecules that target STEAP2, including antibody-drug conjugates, as well as bispecific antigen-binding molecules that bind both STEAP2 and CD3 would be useful in therapeutic settings in which specific targeting and T cell-mediated killing of cells that express STEAP2 is desired.

BRIEF SUMMARY OF THE INVENTION

In a first aspect, the present invention provides antibodies and antigen-binding fragments thereof that bind to human STEAP2. The antibodies according to this aspect of the invention are useful, inter alia, for targeting cells expressing STEAP2. The present invention also provides bispecific antibodies and antigen-binding fragments thereof that bind human STEAP2 and human CD3. The bispecific antibodies according to this aspect of the invention are useful, inter alia, for targeting T cells expressing CD3, and for stimulating T cell activation, e.g., under circumstances where T cell-mediated killing of cells expressing STEAP2 is beneficial or desirable. For example, the bispecific antibodies can direct CD3-mediated T cell activation to specific STEAP2-expressing cells, such as prostate tumor cells.

Exemplary anti-STEAP2 antibodies of the present invention are listed in Tables 1 and 2 herein. Table 1 sets forth the amino acid sequence identifiers of the heavy chain variable regions (HCVRs) and light chain variable regions (LCVRs), as well as heavy chain complementarity determining regions (HCDR1, HCDR2 and HCDR3), and light chain complementarity determining regions (LCDR1, LCDR2 and LCDR3) of the exemplary anti-STEAP2 antibodies. Table 2 sets forth the sequence identifiers of the nucleic acid molecules encoding the HCVRs, LCVRs, HCDR1, HCDR2 HCDR3, LCDR1, LCDR2 and LCDR3 of the exemplary anti-STEAP2 antibodies.

The present invention provides antibodies, or antigen-binding fragments thereof, comprising an HCVR comprising an amino acid sequence selected from any of the HCVR amino acid sequences listed in Table 1, or a substantially similar sequence thereof having at least 90%, at least 95%, at least 98% or at least 99% sequence identity thereto.

The present invention also provides antibodies, or antigen-binding fragments thereof, comprising an LCVR comprising an amino acid sequence selected from any of the LCVR amino acid sequences listed in Table 1, or a substantially similar sequence thereof having at least 90%, at least 95%, at least 98% or at least 99% sequence identity thereto.

The present invention also provides antibodies, or antigen-binding fragments thereof, comprising an HCVR and an LCVR amino acid sequence pair (HCVR/LCVR) comprising any of the HCVR amino acid sequences listed in Table 1 paired with any of the LCVR amino acid sequences listed in Table 1. According to certain embodiments, the present invention provides antibodies, or antigen-binding fragments thereof, comprising an HCVR/LCVR amino acid sequence pair contained within any of the exemplary anti-STEAP2 antibodies listed in Table 1. In certain embodiments, the HCVR/LCVR amino acid sequence pair is selected from the group consisting of SEQ ID NOs: 250/258 (e.g., H2M11162N).

The present invention also provides antibodies, or antigen-binding fragments thereof, comprising a heavy chain CDR1 (HCDR1) comprising an amino acid sequence selected from any of the HCDR1 amino acid sequences listed in Table 1 or a substantially similar sequence thereof having at least 90%, at least 95%, at least 98% or at least 99% sequence identity.

The present invention also provides antibodies, or antigen-binding fragments thereof, comprising a heavy chain CDR2 (HCDR2) comprising an amino acid sequence selected from any of the HCDR2 amino acid sequences listed in Table 1 or a substantially similar sequence thereof having at least 90%, at least 95%, at least 98% or at least 99% sequence identity.

The present invention also provides antibodies, or antigen-binding fragments thereof, comprising a heavy chain CDR3 (HCDR3) comprising an amino acid sequence selected from any of the HCDR3 amino acid sequences listed in Table 1 or a substantially similar sequence thereof having at least 90%, at least 95%, at least 98% or at least 99% sequence identity.

The present invention also provides antibodies, or antigen-binding fragments thereof, comprising a light chain CDR1 (LCDR1) comprising an amino acid sequence selected from any of the LCDR1 amino acid sequences listed in Table 1 or a substantially similar sequence thereof having at least 90%, at least 95%, at least 98% or at least 99% sequence identity.

The present invention also provides antibodies, or antigen-binding fragments thereof, comprising a light chain CDR2 (LCDR2) comprising an amino acid sequence selected from any of the LCDR2 amino acid sequences listed in Table 1 or a substantially similar sequence thereof having at least 90%, at least 95%, at least 98% or at least 99% sequence identity.

The present invention also provides antibodies, or antigen-binding fragments thereof, comprising a light chain CDR3 (LCDR3) comprising an amino acid sequence selected from any of the LCDR3 amino acid sequences listed in Table 1 or a substantially similar sequence thereof having at least 90%, at least 95%, at least 98% or at least 99% sequence identity.

The present invention also provides antibodies, or antigen-binding fragments thereof, comprising an HCDR3 and an LCDR3 amino acid sequence pair (HCDR3/LCDR3) comprising any of the HCDR3 amino acid sequences listed in Table 1 paired with any of the LCDR3 amino acid sequences listed in Table 1. According to certain embodiments, the present invention provides antibodies, or antigen-binding fragments thereof, comprising an HCDR3/LCDR3 amino acid sequence pair contained within any of the exemplary anti-STEAP2 antibodies listed in Table 1. In certain embodiments, the HCDR3/LCDR3 amino acid sequence pair is selected from the group consisting of SEQ ID NOs: 256/264 (e.g., H2M11162N).

The present invention also provides antibodies, or antigen-binding fragments thereof, comprising a set of six CDRs (i.e., HCDR1-HCDR2-HCDR3-LCDR1-LCDR2-LCDR3) contained within any of the exemplary anti-STEAP2 antibodies listed in Table 1. In certain embodiments, the HCDR1-HCDR2-HCDR3-LCDR1-LCDR2-LCDR3 amino acid sequences set is selected from the group consisting of SEQ ID NOs: 252-254-256-260-262-264 (e.g., H2M11162N).

In a related embodiment, the present invention provides antibodies, or antigen-binding fragments thereof, comprising a set of six CDRs (i.e., HCDR1-HCDR2-HCDR3-LCDR1-LCDR2-LCDR3) contained within an HCVR/LCVR amino acid sequence pair as defined by any of the exemplary anti-STEAP2 antibodies listed in Table 1. For example, the present invention includes antibodies, or antigen-binding fragments thereof, comprising the HCDR1-HCDR2-HCDR3-LCDR1-LCDR2-LCDR3 amino acid sequences set contained within an HCVR/LCVR amino acid sequence pair selected from the group consisting of SEQ ID NOs: 250/258 (e.g., H2M11162N). Methods and techniques for identifying CDRs within HCVR and LCVR amino acid sequences are well known in the art and can be used to identify CDRs within the specified HCVR and/or LCVR amino acid sequences disclosed herein. Exemplary conventions that can be used to identify the boundaries of CDRs include, e.g., the Kabat definition, the Chothia definition, and the AbM definition. In general terms, the Kabat definition is based on sequence variability, the Chothia definition is based on the location of the structural loop regions, and the AbM definition is a compromise between the Kabat and Chothia approaches. See, e.g., Kabat, "Sequences of Proteins of Immunological Interest," National Institutes of Health, Bethesda, Md. (1991); Al-Lazikani et al., J. Mol. Biol. 273:927-948 (1997); and Martin et al., Proc. Natl. Acad. Sci. USA 86:9268-9272 (1989). Public databases are also available for identifying CDR sequences within an antibody.

The present invention also provides nucleic acid molecules encoding anti-STEAP2 antibodies or portions thereof. For example, the present invention provides nucleic acid molecules encoding any of the HCVR amino acid sequences listed in Table 1; in certain embodiments the nucleic acid molecule comprises a polynucleotide sequence selected from any of the HCVR nucleic acid sequences listed in Table 2, or a substantially similar sequence thereof having at least 90%, at least 95%, at least 98% or at least 99% sequence identity thereto.

The present invention also provides nucleic acid molecules encoding any of the LCVR amino acid sequences listed in Table 1; in certain embodiments the nucleic acid molecule comprises a polynucleotide sequence selected from any of the LCVR nucleic acid sequences listed in Table 2, or a substantially similar sequence thereof having at least 90%, at least 95%, at least 98% or at least 99% sequence identity thereto.

The present invention also provides nucleic acid molecules encoding any of the HCDR1 amino acid sequences listed in Table 1; in certain embodiments the nucleic acid molecule comprises a polynucleotide sequence selected from any of the HCDR1 nucleic acid sequences listed in Table 2, or a substantially similar sequence thereof having at least 90%, at least 95%, at least 98% or at least 99% sequence identity thereto.

The present invention also provides nucleic acid molecules encoding any of the HCDR2 amino acid sequences listed in Table 1; in certain embodiments the nucleic acid molecule comprises a polynucleotide sequence selected from any of the HCDR2 nucleic acid sequences listed in Table 2, or a substantially similar sequence thereof having at least 90%, at least 95%, at least 98% or at least 99% sequence identity thereto.

The present invention also provides nucleic acid molecules encoding any of the HCDR3 amino acid sequences listed in Table 1; in certain embodiments the nucleic acid molecule comprises a polynucleotide sequence selected from any of the HCDR3 nucleic acid sequences listed in Table 2, or a substantially similar sequence thereof having at least 90%, at least 95%, at least 98% or at least 99% sequence identity thereto.

The present invention also provides nucleic acid molecules encoding any of the LCDR1 amino acid sequences listed in Table 1; in certain embodiments the nucleic acid molecule comprises a polynucleotide sequence selected from any of the LCDR1 nucleic acid sequences listed in Table 2, or a substantially similar sequence thereof having at least 90%, at least 95%, at least 98% or at least 99% sequence identity thereto.

The present invention also provides nucleic acid molecules encoding any of the LCDR2 amino acid sequences listed in Table 1; in certain embodiments the nucleic acid molecule comprises a polynucleotide sequence selected from any of the LCDR2 nucleic acid sequences listed in Table 2, or a substantially similar sequence thereof having at least 90%, at least 95%, at least 98% or at least 99% sequence identity thereto.

The present invention also provides nucleic acid molecules encoding any of the LCDR3 amino acid sequences listed in Table 1; in certain embodiments the nucleic acid molecule comprises a polynucleotide sequence selected from any of the LCDR3 nucleic acid sequences listed in Table 2, or a substantially similar sequence thereof having at least 90%, at least 95%, at least 98% or at least 99% sequence identity thereto.

The present invention also provides nucleic acid molecules encoding an HCVR, wherein the HCVR comprises a set of three CDRs (i.e., HCDR1-HCDR2-HCDR3), wherein the HCDR1-HCDR2-HCDR3 amino acid sequence set is as defined by any of the exemplary anti-STEAP2 antibodies listed in Table 1.

The present invention also provides nucleic acid molecules encoding an LCVR, wherein the LCVR comprises a set of three CDRs (i.e., LCDR1-LCDR2-LCDR3), wherein the LCDR1-LCDR2-LCDR3 amino acid sequence set is as defined by any of the exemplary anti-STEAP2 antibodies listed in Table 1.

The present invention also provides nucleic acid molecules encoding both an HCVR and an LCVR, wherein the HCVR comprises an amino acid sequence of any of the HCVR amino acid sequences listed in Table 1, and wherein the LCVR comprises an amino acid sequence of any of the LCVR amino acid sequences listed in Table 1. In certain embodiments, the nucleic acid molecule comprises a polynucleotide sequence selected from any of the HCVR nucleic acid sequences listed in Table 2, or a substantially similar sequence thereof having at least 90%, at least 95%, at least 98% or at least 99% sequence identity thereto, and a polynucleotide sequence selected from any of the LCVR nucleic acid sequences listed in Table 2, or a substantially similar sequence thereof having at least 90%, at least 95%, at least 98% or at least 99% sequence identity thereto. In certain embodiments according to this aspect of the invention, the nucleic acid molecule encodes an HCVR and LCVR, wherein the HCVR and LCVR are both derived from the same anti-STEAP2 antibody listed in Table 1.

The present invention also provides recombinant expression vectors capable of expressing a polypeptide comprising a heavy or light chain variable region of an anti-STEAP2 antibody. For example, the present invention includes recombinant expression vectors comprising any of the nucleic acid molecules mentioned above, i.e., nucleic acid molecules encoding any of the HCVR, LCVR, and/or CDR sequences as set forth in Table 1. Also included within the scope of the present invention are host cells into which such vectors have been introduced, as well as methods of producing the antibodies or portions thereof by culturing the host cells under conditions permitting production of the antibodies or antibody fragments, and recovering the antibodies and antibody fragments so produced.

The present invention includes anti-STEAP2 antibodies having a modified glycosylation pattern. In some embodiments, modification to remove undesirable glycosylation sites may be useful, or an antibody lacking a fucose moiety present on the oligosaccharide chain, for example, to increase antibody dependent cellular cytotoxicity (ADCC) function (see Shield et al. (2002) JBC 277:26733). In other applications, modification of galactosylation can be made in order to modify complement dependent cytotoxicity (CDC).

In another aspect, the invention provides a pharmaceutical composition comprising a recombinant human antibody or fragment thereof which specifically binds STEAP2 and a pharmaceutically acceptable carrier. In a related aspect, the invention features a composition which is a combination of an anti-STEAP2 antibody and a second therapeutic agent. In one embodiment, the second therapeutic agent is any agent that is advantageously combined with an anti-STEAP2 antibody. Additional combination therapies and co-formulations involving the anti-STEAP2 antibodies of the present invention are disclosed elsewhere herein.

In another aspect, the invention provides therapeutic methods for targeting/killing tumor cells expressing STEAP2 using an anti-STEAP2 antibody of the invention, wherein the therapeutic methods comprise administering a therapeutically effective amount of a pharmaceutical composition comprising an anti-STEAP2 antibody of the invention to a subject in need thereof. In some cases, the anti-STEAP2 antibodies (or antigen-binding fragments thereof) can be used for treating prostate cancer, or may be modified to be more cytotoxic by methods, including but not limited to, modified Fc domains to increase ADCC (see e.g. Shield et al. (2002) JBC 277:26733), radioimmunotherapy, antibody-drug conjugates, or other methods for increasing the efficiency of tumor ablation.

The present invention also includes the use of an anti-STEAP2 antibody of the invention in the manufacture of a medicament for the treatment of a disease or disorder (e.g., cancer) related to or caused by STEAP2-expressing cells. In one aspect, the invention relates to a compound comprising an anti-STEAP2 antibody or antigen-binding fragment, or a STEAP2×CD3 bispecific antibody, as disclosed herein, for use in medicine. In one aspect, the invention relates to a compound comprising an antibody-drug conjugate (ADC) as disclosed herein, for use in medicine.

In yet another aspect, the invention provides monospecific anti-STEAP2 antibodies for diagnostic applications, such as, e.g., imaging reagents.

In yet another aspect, the invention provides therapeutic methods for stimulating T cell activation using an anti-CD3 antibody or antigen-binding portion of an antibody of the invention, wherein the therapeutic methods comprise administering a therapeutically effective amount of a pharmaceutical composition comprising an antibody In another aspect, the present invention provides an isolated antibody or antigen-binding fragment thereof that binds STEAP2-expressing C4-2 cells with an EC50 of less than 50 nM as measured by FACS analysis. In another aspect, the present invention provides an isolated antibody or antigen-binding fragment thereof that binds and is internalized by STEAP2-expressing C4-2 cells.

The invention further provides an antibody or antigen-binding fragment that competes for binding to human STEAP2 with a reference antibody comprising an HCVR/LCVR amino acid sequence pair as set forth in Table 1. In another aspect, the invention provides an antibody or antigen-binding fragment that competes for binding to human STEAP2 with a reference antibody comprising an HCVR/

LCVR amino acid sequence pair selected from the group consisting of SEQ ID NOs:2/10; 18/26; 34/42; 50/58; 66/58; 74/58; 82/58; 90/58; 98/58; 106/114; 122/130; 138/146; 154/162; 170/178; 186/194; 202/210; 218/226; 234/242; 250/258; 266/274; 282/290; 298/306; 314/322; 330/338; 346/354; 362/370; and 378/386.

The invention furthermore provides an antibody or antigen-binding fragment, wherein the antibody or antigen-binding fragment thereof binds to the same epitope on human STEAP2 as a reference antibody comprising an HCVR/LCVR amino acid sequence pair as set forth in Table 1. In another aspect, the antibody or antigen-binding fragment binds to the same epitope on human STEAP2 as a reference antibody comprising an HCVR/LCVR amino acid sequence pair selected from the group consisting of SEQ ID NOs:2/10; 18/26; 34/42; 50/58; 66/58; 74/58; 82/58; 90/58; 98/58; 106/114; 122/130; 138/146; 154/162; 170/178; 186/194; 202/210; 218/226; 234/242; 250/258; 266/274; 282/290; 298/306; 314/322; 330/338; 346/354; 362/370; and 378/386.

The invention further provides an isolated antibody or antigen-binding fragment thereof that binds human STEAP2, wherein the antibody or antigen-binding fragment comprises: the complementarity determining regions (CDRs) of a heavy chain variable region (HCVR) having an amino acid sequence as set forth in Table 1; and the CDRs of a light chain variable region (LCVR) having an amino acid sequence as set forth in Table 1. In another aspect, the isolated antibody or antigen-binding fragment comprises the heavy and light chain CDRs of a HCVR/LCVR amino acid sequence pair selected from the group consisting of: SEQ ID NOs:2/10; 18/26; 34/42; 50/58; 66/58; 74/58; 82/58; 90/58; 98/58; 106/114; 122/130; 138/146; 154/162; 170/178; 186/194; 202/210; 218/226; 234/242; 250/258; 266/274; 282/290; 298/306; 314/322; 330/338; 346/354; 362/370; and 378/386. In yet another aspect, the isolated antibody or antigen-binding fragment comprises HCDR1-HCDR2-HCDR3-LCDR1-LCDR2-LCDR3 domains, respectively, selected from the group consisting of: SEQ ID NOs:4-6-8-12-14-16; 20-22-24-28-30-32; 36-38-40-44-46-48; 52-54-56-60-62-64; 68-70-72-60-62-64; 76-78-80-60-62-64; 84-86-88-60-62-64; 92-94-96-60-62-64; 100-102-104-60-62-64; 108-110-112-116-118-120; 124-126-128-132-134-136; 140-142-144-148-150-152; 156-158-160-164-166-168; 172-174-176-180-182-184; 188-190-192-196-198-200; 204-206-208-212-214-216; 220-222-224-228-230-232; 236-238-240-244-246-248; 252-254-256-260-262-264; 268-270-272-276-278-280; 284-286-288-292-294-296; 300-302-304-308-310-312; 316-318-320-324-326-328; 332-334-336-340-342-344; 348-350-352-356-358-360; 364-366-368-372-374-376; and 380-382-384-388-390-392.

In another aspect, the invention provides an isolated antibody or antigen-binding fragment thereof that binds human STEAP2, wherein the antibody or antigen-binding fragment comprises: (a) a heavy chain variable region (HCVR) having an amino acid sequence selected from the group consisting of SEQ ID NOs: 2, 18, 34, 50, 66, 74, 82, 90, 98, 106, 122, 138, 154, 170, 186, 202, 218, 234, 250, 266, 282, 298, 314, 330, 346, 362, and 378; and (b) a light chain variable region (LCVR) having an amino acid sequence selected from the group consisting of SEQ ID NOs: 10; 26; 42; 58 114; 130; 146; 162; 178; 194; 210; 226; 242; 258; 274; 290; 306; 322; 338; 354; 370; and 386. In a further aspect, the isolated antibody or antigen-binding fragment of claim 10, wherein the antibody or antigen-binding fragment comprises a HCVR/LCVR amino acid sequence pair selected from the group consisting of: SEQ ID NOs:2/10; 18/26; 34/42; 50/58; 66/58; 74/58; 82/58; 90/58; 98/58; 106/114; 122/130; 138/146; 154/162; 170/178; 186/194; 202/210; 218/226; 234/242; 250/258; 266/274; 282/290; 298/306; 314/322; 330/338; 346/354; 362/370; and 378/386.

According to another aspect, the present invention provides antibody-drug conjugates comprising an anti-STEAP2 antibody or antigen-binding fragment thereof and a therapeutic agent (e.g., a cytotoxic agent). In some embodiments, the antibody or antigen-binding fragment and the cytotoxic agent are covalently attached via a linker, as discussed herein. In various embodiments, the anti-STEAP 2 antibody or antigen-binding fragment can be any of the anti-STEAP 2 antibodies or fragments described herein.

In some embodiments, the cytotoxic agent is selected from an auristatin, a maytansinoid, a tubulysin, a tomaymycin derivative, or a dolastatin derivative. In some cases, the cytotoxic agent is an auristatin selected from MMAE or MMAF, or a maytansinoid selected from DM1 or DM4. In some embodiments, the cytotoxic agent is a maytansinoid having the structure of Formula (I) or Formula (II), as discussed herein.

In some embodiments, the cytotoxic agent is a maytansinoid having the structure:

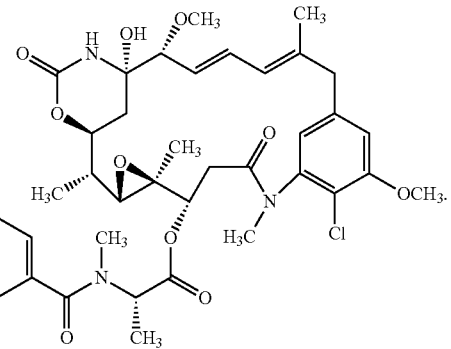

In some embodiments, the cytotoxic agent is a maytansinoid having the structure:

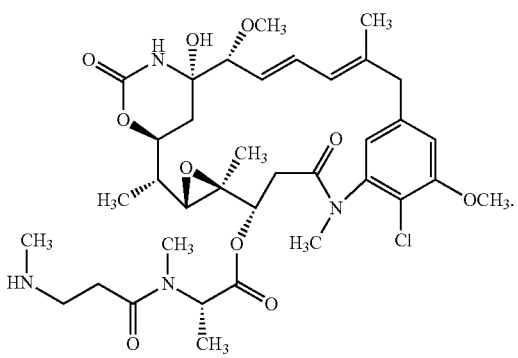 [SMILES: CNCCC(=O)N(C)[C@@H](C)C(=O)O[C@H]1CC(=O)N(C)c2cc(cc(OC)c2Cl)C/C(C)=C/C=C/[C@@H](OC)[C@@]2(O)C[C@H](OC(=O)N2)[C@@H](C)[C@@H]2O[C@@]12C]

In some embodiments, the antibody-drug conjugate comprises an anti-STEAP 2 antibody or fragment thereof, and

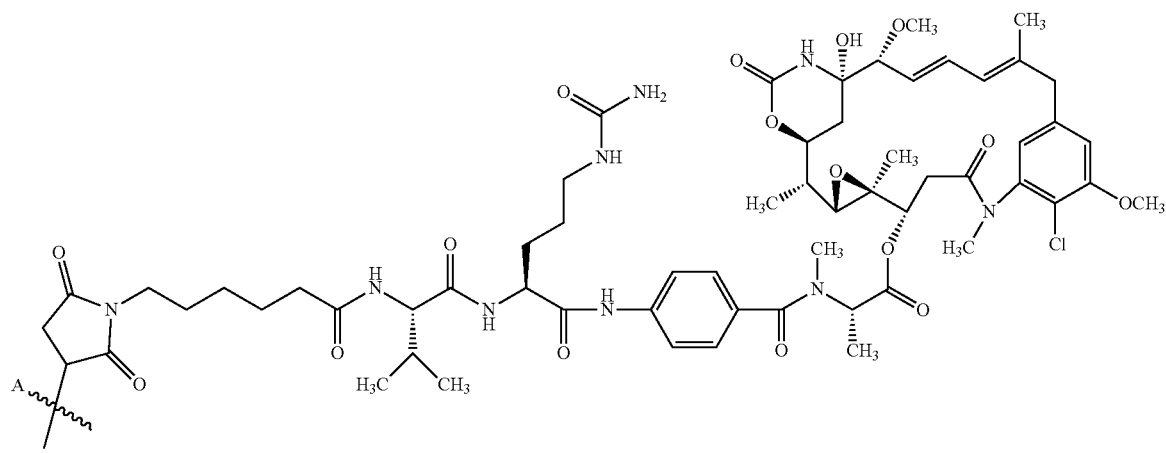
wherein
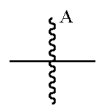
is a bond to the anti-STEAP 2 antibody or fragment thereof.
In some embodiments, the antibody-drug conjugate comprises an anti-STEAP 2 antibody or fragment thereof, and
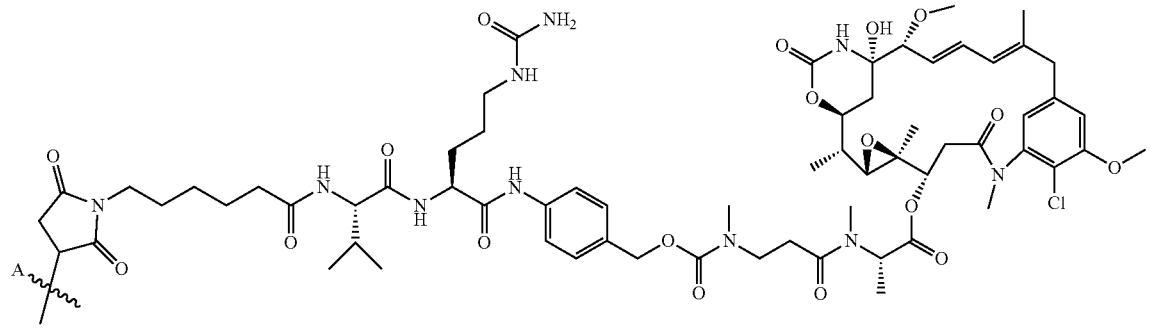
wherein
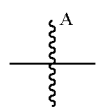
is a bond to the anti-STEAP 2 antibody or fragment thereof.
In some embodiments, the antibody-drug conjugate comprises an anti-STEAP 2 antibody or fragment thereof, and

11

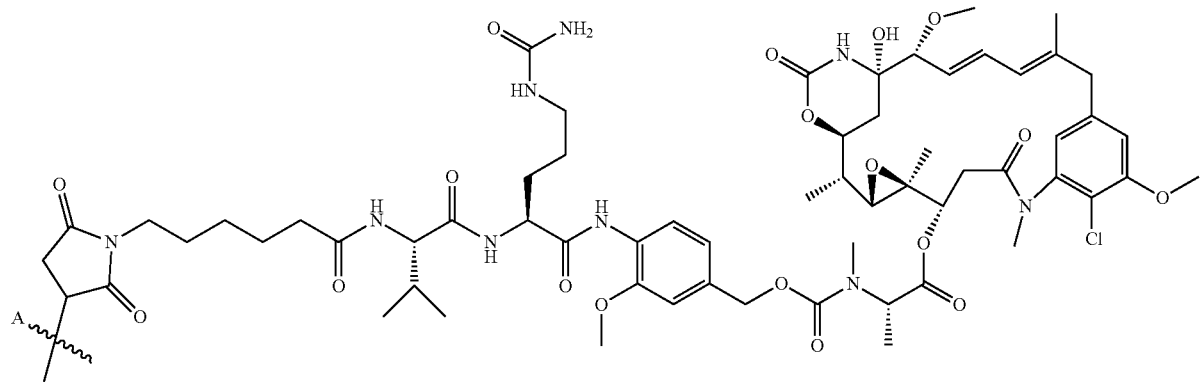

wherein

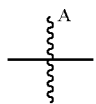

is a bond to the anti-STEAP 2 antibody or fragment thereof.

In some embodiments, the bond contacts the antibody or fragment thereof via a sulfur constituent of a cysteine residue.

In some embodiments, the antibody-drug conjugate comprises an anti-STEAP 2 antibody or fragment thereof, and

12 or a mixture thereof, wherein

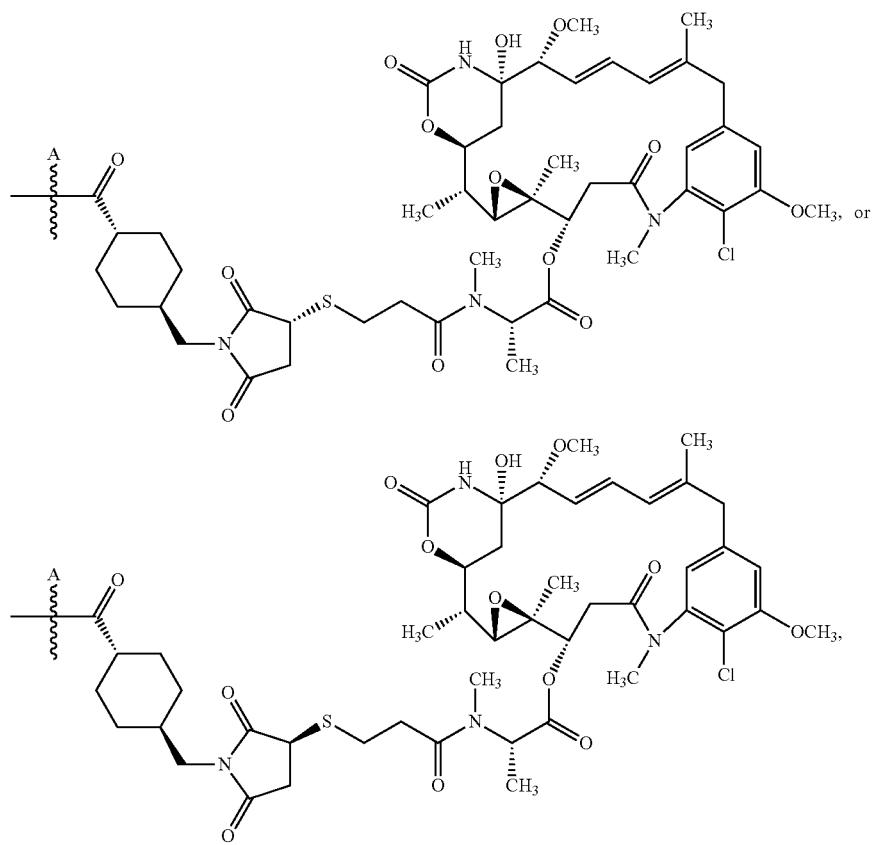

is a bond to the anti-STEAP 2 antibody or fragment thereof.

In some embodiments, the bond contacts the antibody or fragment thereof via a nitrogen constituent of a lysine residue.

In any of the various embodiments of the antibody-drug conjugates discussed above or herein, the antibody-drug conjugate can comprise from 1 to 4 cytotoxic agents per anti-STEAP 2 antibody or fragment thereof.

According to another aspect, the present invention provides bispecific antigen-binding molecules (e.g., antibodies) that bind STEAP2 and CD3. Such bispecific antigen-binding molecules are also referred to herein as "anti-STEAP2/anti-CD3 bispecific molecules," "anti-CD3/anti-STEAP2 bispecific molecules," or "STEAP2×CD3 bsAbs." The anti-STEAP2 portion of the anti-STEAP2/anti-CD3 bispecific molecule is useful for targeting cells (e.g., tumor cells) that express STEAP2 (e.g., prostate tumors), and the anti-CD3 portion of the bispecific molecule is useful for activating T-cells. The simultaneous binding of STEAP2 on a tumor cell and CD3 on a T-cell facilitates directed killing (cell lysis) of the targeted tumor cell by the activated T-cell. The anti-STEAP2/anti-CD3 bispecific molecules of the invention are therefore useful, inter alia, for treating diseases and disorders related to or caused by STEAP2-expressing tumors (e.g., prostate cancers).

The bispecific antigen-binding molecules according to this aspect of the present invention comprise a first antigen-binding domain that specifically binds human CD3, and a second antigen-binding domain that specifically binds STEAP2. The present invention includes anti-STEAP2/anti-CD3 bispecific molecules (e.g., bispecific antibodies) wherein each antigen-binding domain comprises a heavy chain variable region (HCVR) paired with a light chain variable region (LCVR). In certain exemplary embodiments of the invention, the anti-CD3 antigen-binding domain and the anti-STEAP2 antigen binding domain each comprise different, distinct HCVRs paired with a common LCVR. For example, as illustrated in Example 4 herein, bispecific antibodies were constructed comprising a first antigen-binding domain that specifically binds CD3, wherein the first antigen-binding domain comprises an HCVR derived from an anti-CD3 antibody paired with an LCVR derived from an anti-STEAP2 antibody (e.g., the same LCVR that is included in the anti-STEAP2 antigen-binding domain); and a second antigen-binding domain that specifically binds STEAP2, wherein the second antigen-binding domain comprises an HCVR/LCVR derived from an anti-STEAP2 antibody. In other words, in the exemplary molecules disclosed herein, the pairing of an HCVR from an anti-CD3 antibody with an LCVR from an anti-STEAP2 antibody creates an antigen-binding domain that specifically binds CD3 (but does not bind STEAP2). In such embodiments, the first and second antigen-binding domains comprise distinct anti-CD3 and anti-STEAP2 HCVRs but share a common anti-STEAP2 LCVR. In other embodiments, the bispecific antigen-binding molecules comprise distinct anti-CD3 and anti-STEAP2 HCVRs, but share a common LCVR. The amino acid sequence of this LCVR is shown, e.g., in SEQ ID NO:1890, and the amino acid sequences of the corresponding CDRs (i.e., LCDR1-LCDR2-LCDR3) are shown in SEQ ID NOs:1892, 1894, and 1896, respectively. Genetically modified mice can be used to produce fully human bispecific antigen-binding molecules comprising two different heavy chains that associate with an identical light chain that comprises a variable domain derived from one of two different human light chain variable region gene segments. Alternatively, variable heavy chains may be paired with one common light chain and expressed recombinantly in host cells. As such, the antibodies of the invention can comprise immunoglobulin heavy chains associated with a single rearranged light chain. In some embodiments, the light chain comprises a variable domain derived from a human VK1-39 gene segment or a VK3-20 gene segment. In other embodiments, the light chain comprises a variable domain derived from a human VK1-39 gene segment rearranged with a human JK5 or a human JK1 gene segment.

The present invention provides anti-CD3/anti-STEAP2 bispecific molecules, wherein the first antigen-binding domain that specifically binds CD3 comprises any of the HCVR amino acid sequences, any of the LCVR amino acid sequences, any of the HCVR/LCVR amino acid sequence pairs, any of the heavy chain CDR1-CDR2-CDR3 amino acid sequences, or any of the light chain CDR1-CDR2-CDR3 amino acid sequences as set forth in US publication 2014/0088295 published Mar. 27, 2014 and and PCT/US2016/044732 filed Jul. 29, 2016.

In addition, the present invention provides anti-CD3/anti-STEAP2 bispecific molecules, wherein the first antigen-binding domain that specifically binds CD3 comprises any of the HCVR amino acid sequences as set forth in Tables 9, 11, and 15 herein. The first antigen-binding domain that specifically binds CD3 may also comprise any of the LCVR amino acid sequences as set forth in Tables 1, 9, 12, and 17 herein. According to certain embodiments, the first antigen-binding domain that specifically binds CD3 comprises any of the HCVR/LCVR amino acid sequence pairs as set forth in Tables 9, 11, 12, 15, and 17 herein. The present invention also provides anti-CD3/anti-STEAP2 bispecific molecules, wherein the first antigen-binding domain that specifically binds CD3 comprises any of the heavy chain CDR1-CDR2-CDR3 amino acid sequences as set forth in Tables 9, 11, and 15 herein, and/or any of the light chain CDR1-CDR2-CDR3 amino acid sequences as set forth in Tables 1, 9, 12, and 17 herein.

According to certain embodiments, the present invention provides anti-CD3/anti-STEAP2 bispecific molecules, wherein the first antigen-binding domain that specifically binds CD3 comprises a heavy chain variable region (HCVR) having an amino acid sequence as set forth in Tables 9, 11, and 15 herein or a substantially similar sequence thereof having at least 90%, at least 95%, at least 98% or at least 99% sequence identity.

The present invention also provides anti-CD3/anti-STEAP2 bispecific molecules, wherein the first antigen-binding domain that specifically binds CD3 comprises a light chain variable region (LCVR) having an amino acid sequence as set forth in Tables 1, 9, 12, and 17 herein, or a substantially similar sequence thereof having at least 90%, at least 95%, at least 98% or at least 99% sequence identity.

The present invention also provides anti-CD3/anti-STEAP2 bispecific molecules, wherein the first antigen-binding domain that specifically binds CD3 comprises a HCVR and LCVR (HCVR/LCVR) amino acid sequence pair as set forth in Tables 9, 11, 12, 15, and 17 herein.

The present invention also provides anti-CD3/anti-STEAP2 bispecific molecules, wherein the first antigen-binding domain that specifically binds CD3 comprises a heavy chain CDR3 (HCDR3) domain having an amino acid sequence as set forth in Tables 9, 11, and 15 herein, or a substantially similar sequence thereto having at least 90%, at least 95%, at least 98% or at least 99% sequence identity; and a light chain CDR3 (LCDR3) domain having an amino acid sequence as set forth in Tables 1, 9, 12, and 17 herein, or a substantially similar sequence thereof having at least 90%, at least 95%, at least 98% or at least 99% sequence identity.

In certain embodiments, the first antigen-binding domain that specifically binds CD3 comprises a HCDR3/LCDR3 amino acid sequence pair as set forth in Tables 9, 11, 12, 15, and 17 herein.

The present invention also provides anti-CD3/anti-STEAP2 bispecific antigen-binding molecules, wherein the first antigen-binding domain that specifically binds CD3 comprises a heavy chain CDR1 (HCDR1) domain having an amino acid as set forth in Tables 9, 11, and 15 herein, or a substantially similar sequence thereof having at least 90%, at least 95%, at least 98% or at least 99% sequence identity; a heavy chain CDR2 (HCDR2) domain having an amino acid as set forth in Tables 9, 11, and 15, or a substantially similar sequence thereof having at least 90%, at least 95%, at least 98% or at least 99% sequence identity; a heavy chain CDR3 (HCDR3) domain having an amino acid as set forth in Tables 9, 11, and 15, or a substantially similar sequence thereof having at least 90%, at least 95%, at least 98% or at least 99% sequence identity; a light chain CDR1 (LCDR1) domain having an amino acid sequence as set forth in Tables 1, 9, 12, and 17 herein, or a substantially similar sequence thereof having at least 90%, at least 95%, at least 98% or at least 99% sequence identity; a light chain CDR2 (LCDR2) domain having an amino acid sequence as set forth in Tables 1, 9, 12, and 17 herein, or a substantially similar sequence thereof having at least 90%, at least 95%, at least 98% or at least 99% sequence identity, and a light chain CDR3 (LCDR3) domain having an amino acid sequence as set forth in Tables 1, 9, 12, and 17 herein, or a substantially similar sequence thereof having at least 90%, at least 95%, at least 98% or at least 99% sequence identity.

Certain non-limiting, exemplary anti-CD3/anti-STEAP2 bispecific antigen-binding molecules of the invention include a first antigen-binding domain that specifically binds CD3 comprising HCDR1-HCDR2-HCDR3-LCDR1-LCDR2-LCDR3 domains, respectively, having the amino acid sequences as set forth in Tables 9, 11, 12, 15, and 17 herein.

The present invention further provides a bispecific antigen-binding molecule, wherein the first antigen-binding domain that specifically binds human CD3 comprises heavy chain complementarity determining regions (HCDR1, HCDR2 and HCDR3) from a heavy chain variable region (HCVR) comprising an amino acid sequence as set forth in Table 9, Table 11, or Table 15 and light chain complementarity determining regions (LCDR1, LCDR2 and LCDR3) from a light chain variable region (LCVR) comprising an amino acid sequence as set forth in Table 1, Table 9, Table 12, or Table 17.

In another aspect, the invention provides a bispecific antigen-binding molecule wherein the first antigen-binding domain that specifically binds human CD3 comprises heavy chain complementarity determining regions (HCDR1, HCDR2 and HCDR3) from a heavy chain variable region (HCVR) selected from the group consisting of SEQ ID NOs: 1730, 1762, and 1866, and light chain complementarity determining regions (LCDR1, LCDR2 and LCDR3) from a light chain variable region (LCVR) comprising an amino acid sequence selected from the group consisting of SEQ ID NOs: 258.

The invention further provides a bispecific antigen-binding molecule, wherein the first antigen-binding domain that specifically binds human CD3 comprises three heavy chain complementarity determining regions (A1-HCDR1, A1-HCDR2 and A1-HCDR3) and three light chain complementarity determining regions (A1-LCDR1, A1-LCDR2 and A1-LCDR3), wherein A1-HCDR1 comprises an amino acid sequence selected from the group consisting of SEQ ID NOs: 1732, 1764, and 1868; A1-HCDR2 comprises an amino acid sequence selected from the group consisting of SEQ ID NOs: 1734, 1766, and 1870; A1-HCDR3 comprises an amino acid sequence selected from the group consisting of SEQ ID NOs: 1736, 1768, and 1872; A1-LCDR1 comprises an amino acid sequence of SEQ ID NO: 260; A1-LCDR2 comprises an amino acid sequence of SEQ ID NO: 262; and A1-LCDR3 comprises an amino acid sequence of SEQ ID NO: 264.

In a further aspect, the invention provides a bispecific antigen-binding molecule, wherein the first antigen-binding domain that specifically binds human CD3 comprises the heavy and light chain CDRs of a HCVR/LCVR amino acid sequence pair selected from the group consisting of: SEQ ID NOs: 1730/258, 1762/258, and 1866/258.

In another aspect, the invention provides a bispecific antigen-binding molecule, wherein the first antigen-binding domain that specifically binds human CD3 comprises three heavy chain complementarity determining regions (A1-HCDR1, A1-HCDR2 and A1-HCDR3) and three light chain complementarity determining regions (A1-LCDR1, A1-LCDR2 and A1-LCDR3), and wherein the second antigen-binding domain that specifically binds human STEAP2 comprises three heavy chain complementarity determining regions (A2-HCDR1, A2-HCDR2 and A2-HCDR3) and three light chain complementarity determining regions (A2-LCDR1, A2-LCDR2 and A2-LCDR3); wherein A1-HCDR1 comprises an amino acid sequence selected from the group consisting of SEQ ID NOs: 1732, 1764, and 1868; A1-HCDR2 comprises an amino acid sequence selected from the group consisting of SEQ ID NOs: 1734, 1766, and 1870; A1-HCDR3 comprises an amino acid sequence selected from the group consisting of SEQ ID NOs: 1736, 1768, and 1872; A1-LCDR1 comprises an amino acid sequence of SEQ ID NO: 260; A1-LCDR2 comprises an amino acid sequence of SEQ ID NO: 262; and A1-LCDR3 comprises an amino acid sequence of SEQ ID NO: 264; and wherein A2-HCDR1 comprises an amino acid sequence of SEQ ID NO: 252; A2-HCDR2 comprises an amino acid sequence of SEQ ID NO: 254; A2-HCDR3 comprises an amino acid sequence of SEQ ID NO: 256; A2-LCDR1 comprises an amino acid sequence of SEQ ID NO: 260; A2-LCDR2 comprises an amino acid sequence of SEQ ID NO: 262; and A2-LCDR3 comprises an amino acid sequence of SEQ ID NO: 264.

Certain non-limiting, exemplary anti-CD3/anti-STEAP2 bispecific antigen-binding molecules of the invention include a first antigen-binding domain that specifically binds CD3 comprising a heavy chain comprising variable domain framework regions having an amino acid sequence selected from FR1 (SEQ ID NO: 1903), FR2 (SEQ ID NO: 1904), FR3 (SEQ ID NO: 1905), and FR4 (SEQ ID NO: 1906).

In more embodiments, exemplary anti-CD3/anti-STEAP2 bispecific antigen-binding molecules of the invention include a bispecific antigen-binding molecule wherein the first antigen-binding domain that specifically binds human CD3 comprises a HCVR comprising HCDR1-HCDR2-HCDR3 having the amino acid sequences of SEQ ID NOs: 1907-1908-1909

The present invention also provides anti-CD3/anti-STEAP2 bispecific molecules, wherein the second antigen-binding domain that specifically binds STEAP2 comprises a heavy chain variable region (HCVR) having the amino acid sequence selected from the group consisting of SEQ ID NOs: 2, 18, 34, 50, 66, 74, 82, 90, 98, 106, 122, 138, 154, 170, 186, 202, 218, 234, 250, 266, 282, 298, 314, 330, 346, 362, and 378, or a substantially similar sequence thereof having at least 90%, at least 95%, at least 98% or at least 99% sequence identity.

The present invention also provides anti-CD3/anti-STEAP2 bispecific molecules, wherein the second antigen-binding domain that specifically binds STEAP2 comprises a light chain variable region (LCVR) having the amino acid sequence selected from the group consisting of SEQ ID NOs: 10; 26; 42; 58; 114; 130; 146; 162; 178; 194; 210; 226; 242; 258; 274; 290; 306; 322; 338; 354; 370; and 386, or a substantially similar sequence thereof having at least 90%, at least 95%, at least 98% or at least 99% sequence identity.

The present invention also provides anti-CD3/anti-STEAP2 bispecific molecules, wherein the second antigen-binding domain that specifically binds STEAP2 comprises a HCVR and LCVR (HCVR/LCVR) amino acid sequence pair of SEQ ID NO: 250/258.

The present invention also provides anti-CD3/anti-STEAP2 bispecific molecules, wherein the second antigen-binding domain that specifically binds STEAP2 comprises a heavy chain CDR3 (HCDR3) domain having an amino acid sequence of SEQ ID NO:256 or a substantially similar sequence thereto having at least 90%, at least 95%, at least 98% or at least 99% sequence identity; and a light chain CDR3 (LCDR3) domain having an amino acid sequence of SEQ ID NO: 264, or a substantially similar sequence thereof having at least 90%, at least 95%, at least 98% or at least 99% sequence identity.

In certain embodiments, the second antigen-binding domain that specifically binds STEAP2 comprises a HCDR3/LCDR3 amino acid sequence pair selected from the group consisting of SEQ ID NOs:256/264.

The present invention also provides anti-CD3/anti-STEAP2 bispecific antigen-binding molecules, wherein the second antigen-binding domain that specifically binds STEAP2 comprises a heavy chain CDR1 (HCDR1) domain having an amino acid sequence selected from the group consisting of SEQ ID NOs:4, 20, 36, 52, 68, 76, 84, 92, 100, 108, 124, 140, 156, 172, 188, 204, 220, 236, 252, 268, 284, 300, 316, 332, 348, 364, and 380, or a substantially similar sequence thereof having at least 90%, at least 95%, at least 98% or at least 99% sequence identity; a heavy chain CDR2 (HCDR2) domain having an amino acid sequence selected from the group consisting of SEQ ID NOs:6, 22, 38, 54, 70, 78, 86, 94, 102, 110, 126, 142, 158, 174, 190, 206, 222, 238, 254, 270, 286, 302, 318, 334, 350, 366, and 382, or a substantially similar sequence thereof having at least 90%, at least 95%, at least 98% or at least 99% sequence identity; a heavy chain CDR3 (HCDR3) domain having an amino acid sequence selected from the group consisting of SEQ ID NOs:8, 24, 40, 56, 72, 80, 88, 96, 104, 112, 128, 144, 160, 176, 182, 208, 224, 240, 256, 272, 288, 304, 320, 336, 352, 368, and 384, or a substantially similar sequence thereof having at least 90%, at least 95%, at least 98% or at least 99% sequence identity; a light chain CDR1 (LCDR1) domain having an amino acid sequence selected from the group consisting of SEQ ID NOs:12, 28, 44, 60, 116, 132, 148, 164, 180, 196, 212, 228, 244, 260, 276, 292, 308, 324, 340, 356, 372, and 388, or a substantially similar sequence thereof having at least 90%, at least 95%, at least 98% or at least 99% sequence identity; and a light chain CDR2 (LCDR2) domain having an amino acid sequence selected from the group consisting of SEQ ID NOs:14, 30, 46, 62, 118, 134, 150, 166, 182, 198, 214, 230, 246, 262, 278, 294, 310, 326, 342, 358, 374, and 390, or a substantially similar sequence thereof having at least 90%, at least 95%, at least 98% or at least 99% sequence identity; and a light chain CDR3 (LCDR3) domain having an amino acid sequence selected from the group consisting of SEQ ID NOs:16, 32, 48, 64, 120, 136, 152, 168, 184, 200, 216, 232, 248, 264, 280, 296, 312, 328, 344, 360, 376, and 392, or a substantially similar sequence thereof having at least 90%, at least 95%, at least 98% or at least 99% sequence identity.

Certain non-limiting, exemplary anti-CD3/anti-STEAP2 bispecific antigen-binding molecules of the invention include a second antigen-binding domain that specifically binds STEAP2 comprising HCDR1-HCDR2-HCDR3-LCDR1-LCDR2-LCDR3 domains, respectively, having the amino acid sequences selected from the group consisting of: SEQ ID NOs: 252-254-256-260-262-264.

In a related embodiment, the invention includes anti-CD3/anti-STEAP2 bispecific antigen-binding molecules wherein the second antigen-binding domain that specifically binds STEAP2 comprises the heavy and light chain CDR domains contained within heavy and light chain variable region (HCVR/LCVR) sequences selected from the group consisting of SEQ ID NOs: 250/258.

In another aspect, the invention provides a bispecific antigen-binding molecule comprising a first antigen-binding domain that binds human CD3 and a second antigen-binding domain that binds human STEAP2, wherein the second antigen-binding domain is derived from the antibody or antigen-binding fragment of any one of the anti-STEAP2 antibodies of the invention. In a further aspect, the invention provides a bispecific antigen-binding molecule comprising a first antigen-binding domain that specifically binds human CD3, and a second antigen-binding domain that specifically binds human STEAP2.

The invention further provides a bispecific antigen-binding molecule which binds human cells expressing human CD3 and cynomolgus monkey cells expressing cynomolgus CD3. In another aspect, the bispecific antigen-binding molecule binds human cells expressing human STEAP2.

In another aspect the invention provides a bispecific antigen-binding molecule which inhibits tumor growth in immunocompromised mice bearing human prostate cancer xenografts.

In certain embodiments, anti-CD3 antibodies of the invention, antigen-binding fragments and bispecific antibodies thereof were made by replacing amino acid residues of a parental in a stepwise manner based on differences between the germline sequence and the parental antibody sequence.

In some embodiments, the invention provides a bispecific antigen-binding molecule, wherein the second antigen-binding domain competes for binding to human STEAP2 with a reference antigen-binding protein comprising three heavy chain complementarity determining regions (A2-HCDR1, A2-HCDR2 and A2-HCDR3) and three light chain complementarity determining regions (A2-LCDR1, A2-LCDR2 and A2-LCDR3), wherein A2-HCDR1 comprises an amino acid sequence selected from the group consisting of SEQ ID NOs: 252; A2-HCDR2 comprises an amino acid sequence of SEQ ID NO: 254; A2-HCDR3 comprises an amino acid sequence of SEQ ID NO: 256; A2-LCDR1 comprises an amino acid sequence of SEQ ID NO: 260; A2-LCDR2 comprises an amino acid sequence of SEQ ID NO: 262; and A2-LCDR3 comprises an amino acid sequence of SEQ ID NO:264. In some embodiments, the invention provides a bispecific antigen-binding molecule, wherein the second antigen-binding domain competes for binding to human STEAP2 with a reference antigen-binding protein comprising a heavy chain variable region (HCVR) comprising an amino acid sequence of SEQ ID NO: 250, and a light chain variable region (LCVR) comprising an amino acid sequence of SEQ ID NO: 258.

In some embodiments, the invention provides a bispecific antigen-binding molecule, wherein the first antigen-binding domain competes for binding to human CD3 with a reference antigen-binding protein comprising three heavy chain complementarity determining regions (A1-HCDR1, A1-HCDR2 and A1-HCDR3) and three light chain complementarity determining regions (A1-LCDR1, A1-LCDR2 and A1-LCDR3), wherein A1-HCDR1 comprises an amino acid sequence selected from the group consisting of SEQ ID NOs: 1732, 1764, and 1868; A1-HCDR2 comprises an amino acid sequence selected from the group consisting of SEQ ID NOs: 1734, 1766, and 1870; A1-HCDR3 comprises an amino acid sequence selected from the group consisting of SEQ ID NOs: 1736, 1768, and 1872; A1-LCDR1 comprises an amino acid sequence of SEQ ID NO: 260; A1-LCDR2 comprises an amino acid sequence of SEQ ID NO: 262; and A1-LCDR3 comprises an amino acid sequence of SEQ ID NO: 264. In some embodiments, the invention provides a bispecific antigen-binding molecule, wherein the first antigen-binding domain competes for binding to human CD3 with a reference antigen-binding protein comprising a heavy chain variable region (HCVR) comprising an amino acid sequence selected from the group consisting of SEQ ID NOs: 1730, 1762, and 1866, and a light chain variable region (LCVR) comprising an amino acid sequence of SEQ ID NO:258.

In some embodiments, the invention provides a bispecific antigen-binding molecule, wherein the first antigen-binding domain competes for binding to human CD3 with a reference antigen-binding protein comprising a heavy chain variable region (HCVR) comprising an amino acid sequence selected from the group consisting of SEQ ID NOs: 1730, 1762, and 1866, and a light chain variable region (LCVR) comprising an amino acid sequence of SEQ ID NO:258; and wherein the second antigen-binding domain competes for binding to human STEAP2 with a reference antigen-binding protein comprising a heavy chain variable region (HCVR) comprising an amino acid sequence of SEQ ID NO:250, and a light chain variable region (LCVR) comprising an amino acid sequence of SEQ ID NO: 258.

In one aspect, the invention provides a pharmaceutical composition comprising an anti-STEAP2 antigen-binding molecule or anti-STEAP2/anti-CD3 bispecific antigen-binding molecule and a pharmaceutically acceptable carrier or diluent. The invention further provides a method for treating a cancer in a subject, the method comprising administering to the subject the pharmaceutical composition comprising an anti-STEAP2 antigen-binding molecule or anti-STEAP2/anti-CD3 bispecific antigen-binding molecule and a pharmaceutically acceptable carrier or diluent. In some embodiments, the cancer is selected from the group consisting of prostate cancer, bladder cancer, cervical cancer, lung cancer, colon cancer, kidney cancer, breast cancer, pancreatic cancer, stomach cancer, uterine cancer, and ovarian cancer. In some cases, the cancer is prostate cancer. In some cases, the prostate cancer is castrate-resistant prostate cancer.

In another aspect, the present invention provides nucleic acid molecules encoding any of the HCVR, LCVR or CDR sequences of the anti-CD3/anti-STEAP2 bispecific antigen-binding molecules disclosed herein, including nucleic acid molecules comprising the polynucleotide sequences as set forth in Tables 2, 10, 13, 14, 16, and 18 herein, as well as nucleic acid molecules comprising two or more of the polynucleotide sequences as set forth in Tables 2, 10, 13, 14, 16, and 18 in any functional combination or arrangement thereof. Recombinant expression vectors carrying the nucleic acids of the invention, and host cells into which such vectors have been introduced, are also encompassed by the invention, as are methods of producing the antibodies by culturing the host cells under conditions permitting production of the antibodies, and recovering the antibodies produced.

The present invention includes anti-CD3/anti-STEAP2 bispecific antigen-binding molecules wherein any of the aforementioned antigen-binding domains that specifically bind CD3 are combined, connected or otherwise associated with any of the aforementioned antigen-binding domains that specifically bind STEAP2 to form a bispecific antigen-binding molecule that binds CD3 and STEAP2.

The present invention includes anti-CD3/anti-STEAP2 bispecific antigen-binding molecules having a modified glycosylation pattern. In some applications, modification to remove undesirable glycosylation sites may be useful, or an antibody lacking a fucose moiety present on the oligosaccharide chain, for example, to increase antibody dependent cellular cytotoxicity (ADCC) function (see Shield et al. (2002) JBC 277:26733). In other applications, modification of galactosylation can be made in order to modify complement dependent cytotoxicity (CDC).

In another aspect, the invention provides a pharmaceutical composition comprising an anti-CD3/anti-STEAP2 bispecific antigen-binding molecule as disclosed herein and a pharmaceutically acceptable carrier. In a related aspect, the invention features a composition which is a combination of an anti-CD3/anti-STEAP2 bispecific antigen-binding molecule and a second therapeutic agent. In one embodiment, the second therapeutic agent is any agent that is advantageously combined with an anti-CD3/anti-STEAP2 bispecific antigen-binding molecule. Exemplary agents that may be advantageously combined with an anti-CD3/anti-STEAP2 bispecific antigen-binding molecule are discussed in detail elsewhere herein.

In yet another aspect, the invention provides therapeutic methods for targeting/killing tumor cells expressing STEAP2 using an anti-CD3/anti-STEAP2 bispecific antigen-binding molecule of the invention, wherein the therapeutic methods comprise administering a therapeutically effective amount of a pharmaceutical composition comprising an anti-CD3/anti-STEAP2 bispecific antigen-binding molecule of the invention to a subject in need thereof.

The present invention also includes the use of an anti-CD3/anti-STEAP2 bispecific antigen-binding molecule of the invention in the manufacture of a medicament for the treatment of a disease or disorder related to or caused by STEAP2-expressing cells.

Other embodiments will become apparent from a review of the ensuing detailed description.

DETAILED DESCRIPTION

Figure 1:
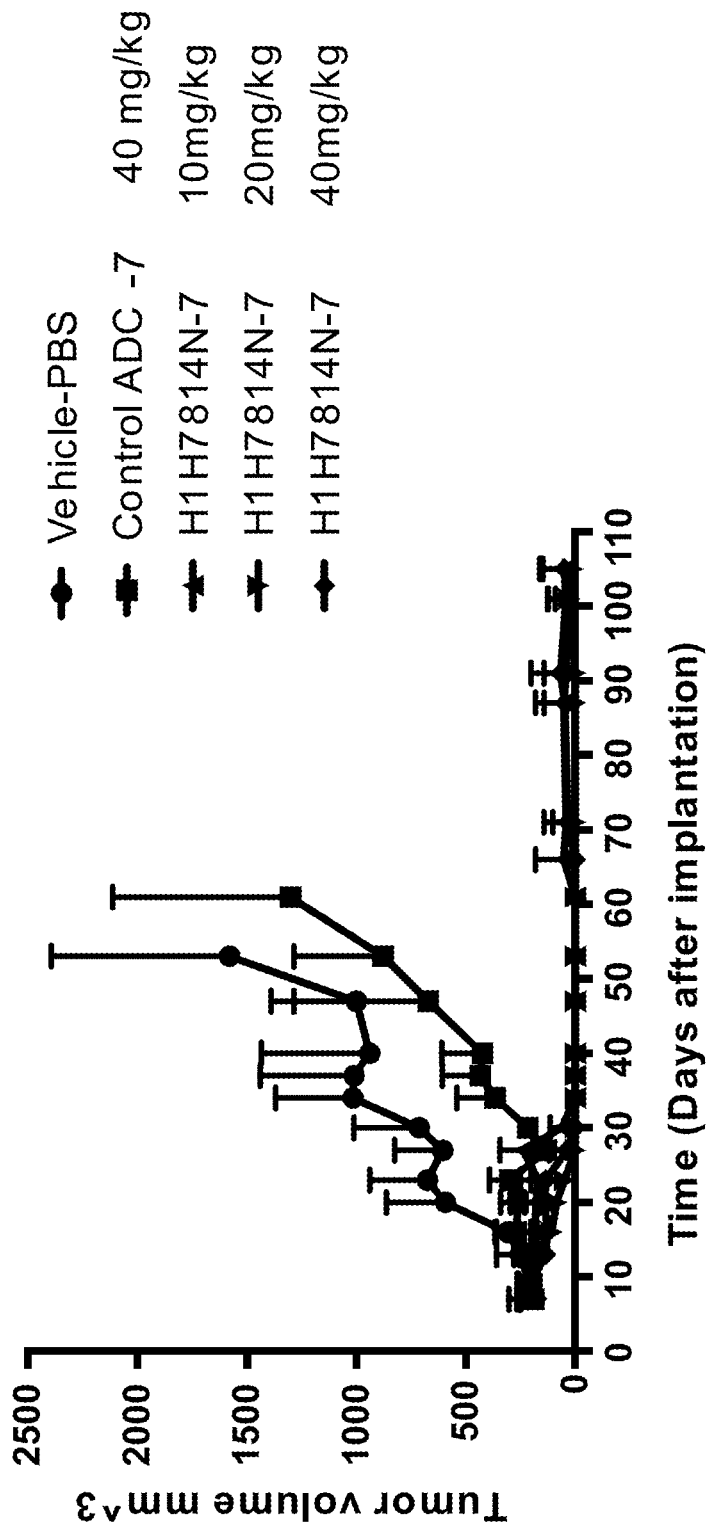
FIG. 1 shows efficacy of H1H7814N-7 in a STEAP2 positive prostate cancer xenograft model (SCID mice implanted with C4-2 cells) at a dose of 10, 20, or 40 mg/kg H1H7814N-7 administered on day 13 after implantation.

Before the present invention is described, it is to be understood that this invention is not limited to particular methods and experimental conditions described, as such methods and conditions may vary. It is also to be understood that the terminology used herein is for the purpose of describing particular embodiments only, and is not intended to be limiting, since the scope of the present invention will be limited only by the appended claims.

Unless defined otherwise, all technical and scientific terms used herein have the same meaning as commonly understood by one of ordinary skill in the art to which this invention belongs. As used herein, the term "about," when used in reference to a particular recited numerical value, means that the value may vary from the recited value by no more than 1%. For example, as used herein, the expression "about 100" includes 99 and 101 and all values in between (e.g., 99.1, 99.2, 99.3, 99.4, etc.).

Although any methods and materials similar or equivalent to those described herein can be used in the practice or testing of the present invention, the preferred methods and materials are now described. All patents, applications and non-patent publications mentioned in this specification are incorporated herein by reference in their entireties.

Definitions

The expression "CD3," as used herein, refers to an antigen which is expressed on T cells as part of the multimolecular T cell receptor (TCR) and which consists of a homodimer or heterodimer formed from the association of two of four receptor chains: CD3-epsilon, CD3-delta, CD3-zeta, and CD3-gamma. Human CD3-epsilon comprises the amino acid sequence as set forth in SEQ ID NO:1897; human CD3-delta comprises the amino acid sequence as set forth in SEQ ID NO:1898. All references to proteins, polypeptides and protein fragments herein are intended to refer to the human version of the respective protein, polypeptide or protein fragment unless explicitly specified as being from a non-human species. Thus, the expression "CD3" means human CD3 unless specified as being from a non-human species, e.g., "mouse CD3," "monkey CD3," etc.

As used herein, "an antibody that binds CD3" or an "anti-CD3 antibody" includes antibodies and antigen-binding fragments thereof that specifically recognize a single CD3 subunit (e.g., epsilon, delta, gamma or zeta), as well as antibodies and antigen-binding fragments thereof that specifically recognize a dimeric complex of two CD3 subunits (e.g., gamma/epsilon, delta/epsilon, and zeta/zeta CD3 dimers). The antibodies and antigen-binding fragments of the present invention may bind soluble CD3 and/or cell surface expressed CD3. Soluble CD3 includes natural CD3 proteins as well as recombinant CD3 protein variants such as, e.g., monomeric and dimeric CD3 constructs, that lack a transmembrane domain or are otherwise unassociated with a cell membrane.

As used herein, the expression "cell surface-expressed CD3" means one or more CD3 protein(s) that is/are expressed on the surface of a cell in vitro or in vivo, such that at least a portion of a CD3 protein is exposed to the extracellular side of the cell membrane and is accessible to an antigen-binding portion of an antibody. "Cell surface-expressed CD3" includes CD3 proteins contained within the context of a functional T cell receptor in the membrane of a cell. The expression "cell surface-expressed CD3" includes CD3 protein expressed as part of a homodimer or heterodimer on the surface of a cell (e.g., gamma/epsilon, delta/epsilon, and zeta/zeta CD3 dimers). The expression, "cell surface-expressed CD3" also includes a CD3 chain (e.g., CD3-epsilon, CD3-delta or CD3-gamma) that is expressed by itself, without other CD3 chain types, on the surface of a cell. A "cell surface-expressed CD3" can comprise or consist of a CD3 protein expressed on the surface of a cell which normally expresses CD3 protein. Alternatively, "cell surface-expressed CD3" can comprise or consist of CD3 protein expressed on the surface of a cell that normally does not express human CD3 on its surface but has been artificially engineered to express CD3 on its surface.

The expression "STEAP2," as used herein, refers to six-transmembrane epithelial antigen of prostate 2. STEAP2 is an integral, six-transmembrane-spanning protein that is highly expressed in prostate epithelial cells and is a cell-surface marker for prostate cancer, for example STEAP2 was found to be expressed in significant levels on an LNCaP prostate cell line (Porkka, et al. Lab Invest 2002, 82:1573-1582). STEAP2 (UniProtKB/Swiss-Prot: Q8NFT2.3) is a 490-amino acid protein encoded by STEAP2 gene located at the chromosomal region 7q21 in humans, see e.g. the amino acid sequence of human STEAP2 as set forth in SEQ ID NO:1899.

As used herein, "an antibody that binds STEAP2" or an "anti-STEAP2 antibody" includes antibodies and antigen-binding fragments thereof that specifically recognize STEAP2.

The term "antigen-binding molecule" includes antibodies and antigen-binding fragments of antibodies, including, e.g., bispecific antibodies.

The term "antibody", as used herein, means any antigen-binding molecule or molecular complex comprising at least one complementarity determining region (CDR) that specifically binds to or interacts with a particular antigen (e.g., STEAP2 or CD3). The term "antibody" includes immunoglobulin molecules comprising four polypeptide chains, two heavy (H) chains and two light (L) chains inter-connected by disulfide bonds, as well as multimers thereof (e.g., IgM). Each heavy chain comprises a heavy chain variable region (abbreviated herein as HCVR or $V_H$) and a heavy chain constant region. The heavy chain constant region comprises three domains, $C_H1$, $C_H2$ and $C_H3$. Each light chain comprises a light chain variable region (abbreviated herein as LCVR or $V_L$) and a light chain constant region. The light chain constant region comprises one domain ($C_L1$). The $V_H$ and $V_L$ regions can be further subdivided into regions of hypervariability, termed complementarity determining regions (CDRs), interspersed with regions that are more conserved, termed framework regions (FR). Each $V_H$ and $V_L$ is composed of three CDRs and four FRs, arranged from amino-terminus to carboxy-terminus in the following order: FR1, CDR1, FR2, CDR2, FR3, CDR3, FR4. In different embodiments of the invention, the FRs of the anti-STEAP2 antibody or anti-CD3 antibody (or antigen-binding portion thereof) may be identical to the human germline sequences, or may be naturally or artificially modified. An amino acid consensus sequence may be defined based on a side-by-side analysis of two or more CDRs.

The term "antibody", as used herein, also includes antigen-binding fragments of full antibody molecules. The terms "antigen-binding portion" of an antibody, "antigen-binding fragment" of an antibody, and the like, as used herein, include any naturally occurring, enzymatically obtainable, synthetic, or genetically engineered polypeptide or glycoprotein that specifically binds an antigen to form a complex. Antigen-binding fragments of an antibody may be derived, e.g., from full antibody molecules using any suitable standard techniques such as proteolytic digestion or recombinant genetic engineering techniques involving the manipulation and expression of DNA encoding antibody variable and optionally constant domains. Such DNA is known and/or is readily available from, e.g., commercial sources, DNA libraries (including, e.g., phage-antibody libraries), or can be synthesized. The DNA may be sequenced and manipulated chemically or by using molecular biology techniques, for example, to arrange one or more variable and/or constant domains into a suitable configuration, or to introduce codons, create cysteine residues, modify, add or delete amino acids, etc.

Non-limiting examples of antigen-binding fragments include: (i) Fab fragments; (ii) F(ab')2 fragments; (iii) Fd fragments; (iv) Fv fragments; (v) single-chain Fv (scFv) molecules; (vi) dAb fragments; and (vii) minimal recognition units consisting of the amino acid residues that mimic the hypervariable region of an antibody (e.g., an isolated complementarity determining region (CDR) such as a CDR3 peptide), or a constrained FR3-CDR3-FR4 peptide). Other engineered molecules, such as domain-specific antibodies, single domain antibodies, domain-deleted antibodies, chimeric antibodies, CDR-grafted antibodies, diabodies, triabodies, tetrabodies, minibodies, nanobodies (e.g. monovalent nanobodies, bivalent nanobodies, etc.), small modular immunopharmaceuticals (SMIPs), and shark variable IgNAR domains, are also encompassed within the expression "antigen-binding fragment," as used herein.

An antigen-binding fragment of an antibody will typically comprise at least one variable domain. The variable domain may be of any size or amino acid composition and will generally comprise at least one CDR which is adjacent to or in frame with one or more framework sequences. In antigen-binding fragments having a $V_H$ domain associated with a $V_L$ domain, the $V_H$ and $V_L$ domains may be situated relative to one another in any suitable arrangement. For example, the variable region may be dimeric and contain $V_H$-$V_H$, $V_H$-$V_L$ or $V_L$-$V_L$ dimers. Alternatively, the antigen-binding fragment of an antibody may contain a monomeric $V_H$ or $V_L$ domain.

In certain embodiments, an antigen-binding fragment of an antibody may contain at least one variable domain covalently linked to at least one constant domain. Non-limiting, exemplary configurations of variable and constant domains that may be found within an antigen-binding fragment of an antibody of the present invention include: (i) $V_H$-$C_H1$; (ii) $V_H$-$C_H2$; (iii) $V_H$-$C_H3$; (iv) $V_H$-$C_H1$-$C_H2$; (v) $V_H$-$C_H1$-$C_H2$-$C_H3$; (vi) $V_H$-$C_H2$-$C_H3$; (vii) $V_H$-$C_L$; (viii) $V_L$-$C_H1$; (ix) $V_L$-$C_H2$; (x) $V_L$-$C_H3$; (xi) $V_L$-$C_H1$-$C_H2$; (xii) $V_L$-$C_H1$-$C_H2$-$C_H3$; (xiii) $V_L$-$C_H2$-$C_H3$; and (xiv) $V_L$-$C_L$. In any configuration of variable and constant domains, including any of the exemplary configurations listed above, the variable and constant domains may be either directly linked to one another or may be linked by a full or partial hinge or linker region. A hinge region may consist of at least 2 (e.g., 5, 10, 15, 20, 40, 60 or more) amino acids which result in a flexible or semi-flexible linkage between adjacent variable and/or constant domains in a single polypeptide molecule. Moreover, an antigen-binding fragment of an antibody of the present invention may comprise a homo-dimer or hetero-dimer (or other multimer) of any of the variable and constant domain configurations listed above in non-covalent association with one another and/or with one or more monomeric $V_H$ or $V_L$ domain (e.g., by disulfide bond(s)).

As with full antibody molecules, antigen-binding fragments may be monospecific or multispecific (e.g., bispecific). A multispecific antigen-binding fragment of an antibody will typically comprise at least two different variable domains, wherein each variable domain is capable of specifically binding to a separate antigen or to a different epitope on the same antigen. Any multispecific antibody format, including the exemplary bispecific antibody formats disclosed herein, may be adapted for use in the context of an antigen-binding fragment of an antibody of the present invention using routine techniques available in the art.

The antibodies of the present invention may function through complement-dependent cytotoxicity (CDC) or antibody-dependent cell-mediated cytotoxicity (ADCC). "Complement-dependent cytotoxicity" (CDC) refers to lysis of antigen-expressing cells by an antibody of the invention in the presence of complement. "Antibody-dependent cell-mediated cytotoxicity" (ADCC) refers to a cell-mediated reaction in which nonspecific cytotoxic cells that express Fc receptors (FcRs) (e.g., Natural Killer (NK) cells, neutrophils, and macrophages) recognize bound antibody on a target cell and thereby lead to lysis of the target cell. CDC and ADCC can be measured using assays that are well known and available in the art. (See, e.g., U.S. Pat. Nos. 5,500,362 and 5,821,337, and Clynes et al. (1998) Proc. Natl. Acad. Sci. (USA) 95:652-656). The constant region of an antibody is important in the ability of an antibody to fix complement and mediate cell-dependent cytotoxicity. Thus, the isotype of an antibody may be selected on the basis of whether it is desirable for the antibody to mediate cytotoxicity.

In certain embodiments of the invention, the anti-STEAP2 monospecific antibodies or anti-STEAP2/anti-CD3 bispecific antibodies of the invention are human antibodies. The term "human antibody", as used herein, is intended to include antibodies having variable and constant regions derived from human germline immunoglobulin sequences. The human antibodies of the invention may include amino acid residues not encoded by human germline immunoglobulin sequences (e.g., mutations introduced by random or site-specific mutagenesis in vitro or by somatic mutation in vivo), for example in the CDRs and in particular CDR3. However, the term "human antibody", as used herein, is not intended to include antibodies in which CDR sequences derived from the germline of another mammalian species, such as a mouse, have been grafted onto human framework sequences.

The antibodies of the invention may, in some embodiments, be recombinant human antibodies. The term "recombinant human antibody", as used herein, is intended to include all human antibodies that are prepared, expressed, created or isolated by recombinant means, such as antibodies expressed using a recombinant expression vector transfected into a host cell (described further below), antibodies isolated from a recombinant, combinatorial human antibody library (described further below), antibodies isolated from an animal (e.g., a mouse) that is transgenic for human immunoglobulin genes (see e.g., Taylor et al. (1992) Nucl. Acids Res. 20:6287-6295) or antibodies prepared, expressed, created or isolated by any other means that involves splicing of human immunoglobulin gene sequences to other DNA sequences. Such recombinant human antibodies have variable and constant regions derived from human germline immunoglobulin sequences. In certain embodiments, however, such recombinant human antibodies are subjected to in vitro mutagenesis (or, when an animal transgenic for human Ig sequences is used, in vivo somatic mutagenesis) and thus the amino acid sequences of the $V_H$ and $V_L$ regions of the recombinant antibodies are sequences that, while derived from and related to human germline $V_H$ and $V_L$ sequences, may not naturally exist within the human antibody germline repertoire in vivo.

Human antibodies can exist in two forms that are associated with hinge heterogeneity. In one form, an immunoglobulin molecule comprises a stable four chain construct of approximately 150-160 kDa in which the dimers are held together by an interchain heavy chain disulfide bond. In a second form, the dimers are not linked via inter-chain disulfide bonds and a molecule of about 75-80 kDa is formed composed of a covalently coupled light and heavy chain (half-antibody). These forms have been extremely difficult to separate, even after affinity purification.

The frequency of appearance of the second form in various intact IgG isotypes is due to, but not limited to, structural differences associated with the hinge region isotype of the antibody. A single amino acid substitution in the hinge region of the human IgG4 hinge can significantly reduce the appearance of the second form (Angal et al. (1993) Molecular Immunology 30:105) to levels typically observed using a human IgG1 hinge. The instant invention encompasses antibodies having one or more mutations in the hinge, $C_H2$ or $C_H3$ region which may be desirable, for example, in production, to improve the yield of the desired antibody form.

The antibodies of the invention may be isolated antibodies. An "isolated antibody," as used herein, means an antibody that has been identified and separated and/or recovered from at least one component of its natural environment. For example, an antibody that has been separated or removed from at least one component of an organism, or from a tissue or cell in which the antibody naturally exists or is naturally produced, is an "isolated antibody" for purposes of the present invention. An isolated antibody also includes an antibody in situ within a recombinant cell. Isolated antibodies are antibodies that have been subjected to at least one purification or isolation step. According to certain embodiments, an isolated antibody may be substantially free of other cellular material and/or chemicals.

The present invention also includes one-arm antibodies that bind STEAP2. As used herein, a "one-arm antibody" means an antigen-binding molecule comprising a single antibody heavy chain and a single antibody light chain. The one-arm antibodies of the present invention may comprise any of the HCVR/LCVR or CDR amino acid sequences as set forth in Table 1.

The anti-STEAP2 or anti-STEAP2/anti-CD3 antibodies disclosed herein may comprise one or more amino acid substitutions, insertions and/or deletions in the framework and/or CDR regions of the heavy and light chain variable domains as compared to the corresponding germline sequences from which the antibodies were derived. Such mutations can be readily ascertained by comparing the amino acid sequences disclosed herein to germline sequences available from, for example, public antibody sequence databases. The present invention includes antibodies, and antigen-binding fragments thereof, which are derived from any of the amino acid sequences disclosed herein, wherein one or more amino acids within one or more framework and/or CDR regions are mutated to the corresponding residue(s) of the germline sequence from which the antibody was derived, or to the corresponding residue(s) of another human germline sequence, or to a conservative amino acid substitution of the corresponding germline residue(s) (such sequence changes are referred to herein collectively as "germline mutations"). A person of ordinary skill in the art, starting with the heavy and light chain variable region sequences disclosed herein, can easily produce numerous antibodies and antigen-binding fragments which comprise one or more individual germline mutations or combinations thereof. In certain embodiments, all of the framework and/or CDR residues within the $V_H$ and/or $V_L$ domains are mutated back to the residues found in the original germline sequence from which the antibody was derived. In other embodiments, only certain residues are mutated back to the original germline sequence, e.g., only the mutated residues found within the first 8 amino acids of FR1 or within the last 8 amino acids of FR4, or only the mutated residues found within CDR1, CDR2 or CDR3. In other embodiments, one or more of the framework and/or CDR residue(s) are mutated to the corresponding residue(s) of a different germline sequence (i.e., a germline sequence that is different from the germline sequence from which the antibody was originally derived). Furthermore, the antibodies of the present invention may contain any combination of two or more germline mutations within the framework and/or CDR regions, e.g., wherein certain individual residues are mutated to the corresponding residue of a particular germline sequence while certain other residues that differ from the original germline sequence are maintained or are mutated to the corresponding residue of a different germline sequence. Once obtained, antibodies and antigen-binding fragments that contain one or more germline mutations can be easily tested for one or more desired property such as, improved binding specificity, increased binding affinity, improved or enhanced antagonistic or agonistic biological properties (as the case may be), reduced immunogenicity, etc. Antibodies and antigen-binding fragments obtained in this general manner are encompassed within the present invention.

The present invention also includes anti-STEAP2 or anti-STEAP2/anti-CD3 antibodies comprising variants of any of the HCVR, LCVR, and/or CDR amino acid sequences disclosed herein having one or more conservative substitutions. For example, the present invention includes anti-STEAP2 or anti-STEAP2/anti-CD3 antibodies having HCVR, LCVR, and/or CDR amino acid sequences with, e.g., 10 or fewer, 8 or fewer, 6 or fewer, 4 or fewer, etc. conservative amino acid substitutions relative to any of the HCVR, LCVR, and/or CDR amino acid sequences set forth in Table 1 herein or as described in Tables 9, 11, 12, 15, and 17 herein.

The term "epitope" refers to an antigenic determinant that interacts with a specific antigen binding site in the variable region of an antibody molecule known as a paratope. A single antigen may have more than one epitope. Thus, different antibodies may bind to different areas on an antigen and may have different biological effects. Epitopes may be either conformational or linear. A conformational epitope is produced by spatially juxtaposed amino acids from different segments of the linear polypeptide chain. A linear epitope is one produced by adjacent amino acid residues in a polypeptide chain. In certain circumstance, an epitope may include moieties of saccharides, phosphoryl groups, or sulfonyl groups on the antigen.

The term "substantial identity" or "substantially identical," when referring to a nucleic acid or fragment thereof, indicates that, when optimally aligned with appropriate nucleotide insertions or deletions with another nucleic acid (or its complementary strand), there is nucleotide sequence identity in at least about 95%, and more preferably at least about 96%, 97%, 98% or 99% of the nucleotide bases, as measured by any well-known algorithm of sequence identity, such as FASTA, BLAST or Gap, as discussed below. A nucleic acid molecule having substantial identity to a reference nucleic acid molecule may, in certain instances, encode a polypeptide having the same or substantially similar amino acid sequence as the polypeptide encoded by the reference nucleic acid molecule.

As applied to polypeptides, the term "substantial similarity" or "substantially similar" means that two peptide sequences, when optimally aligned, such as by the programs GAP or BESTFIT using default gap weights, share at least 95% sequence identity, even more preferably at least 98% or 99% sequence identity. Preferably, residue positions which are not identical differ by conservative amino acid substitutions. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein. In cases where two or more amino acid sequences differ from each other by conservative substitutions, the percent sequence identity or degree of similarity may be adjusted upwards to correct for the conservative nature of the substitution. Means for making this adjustment are well-known to those of skill in the art. See, e.g., Pearson (1994) Methods Mol. Biol. 24: 307-331, herein incorporated by reference. Examples of groups of amino acids that have side chains with similar chemical properties include (1) aliphatic side chains: glycine, alanine, valine, leucine and isoleucine; (2) aliphatic-hydroxyl side chains: serine and threonine; (3) amide-containing side chains: asparagine and glutamine; (4) aromatic side chains: phenylalanine, tyrosine, and tryptophan; (5) basic side chains: lysine, arginine, and histidine; (6) acidic side chains: aspartate and glutamate, and (7) sulfur-containing side chains are cysteine and methionine. Preferred conservative amino acids substitution groups are: valine-leucine-isoleucine, phenylalanine-tyrosine, lysine-arginine, alanine-valine, glutamate-aspartate, and asparagine-glutamine. Alternatively, a conservative replacement is any change having a positive value in the PAM250 log-likelihood matrix disclosed in Gonnet et al. (1992) Science 256: 1443-1445, herein incorporated by reference. A "moderately conservative" replacement is any change having a nonnegative value in the PAM250 log-likelihood matrix.

Sequence similarity for polypeptides, which is also referred to as sequence identity, is typically measured using sequence analysis software. Protein analysis software matches similar sequences using measures of similarity assigned to various substitutions, deletions and other modifications, including conservative amino acid substitutions. For instance, GCG software contains programs such as Gap and Bestfit which can be used with default parameters to determine sequence homology or sequence identity between closely related polypeptides, such as homologous polypeptides from different species of organisms or between a wild type protein and a mutein thereof. See, e.g., GCG Version 6.1. Polypeptide sequences also can be compared using FASTA using default or recommended parameters, a program in GCG Version 6.1. FASTA (e.g., FASTA2 and FASTA3) provides alignments and percent sequence identity of the regions of the best overlap between the query and search sequences (Pearson (2000) supra). Another preferred algorithm when comparing a sequence of the invention to a database containing a large number of sequences from different organisms is the computer program BLAST, especially BLASTP or TBLASTN, using default parameters. See, e.g., Altschul et al. (1990) J. Mol. Biol. 215:403-410 and Altschul et al. (1997) Nucleic Acids Res. 25:3389-402, each herein incorporated by reference.

Germline Mutations

The anti-CD3 antibodies disclosed herein comprise one or more amino acid substitutions, insertions and/or deletions in the framework and/or CDR regions of the heavy chain variable domains as compared to the corresponding germline sequences from which the antibodies were derived.

The present invention also includes antibodies, and antigen-binding fragments thereof, which are derived from any of the amino acid sequences disclosed herein, wherein one or more amino acids within one or more framework and/or CDR regions are mutated to the corresponding residue(s) of the germline sequence from which the antibody was derived, or to the corresponding residue(s) of another human germline sequence, or to a conservative amino acid substitution of the corresponding germline residue(s) (such sequence changes are referred to herein collectively as "germline mutations"), and having weak or no detectable binding to a CD3 antigen. Several such exemplary antibodies that recognize CD3 are described in Tables 12 and 18 herein.

Furthermore, the antibodies of the present invention may contain any combination of two or more germline mutations within the framework and/or CDR regions, e.g., wherein certain individual residues are mutated to the corresponding residue of a particular germline sequence while certain other residues that differ from the original germline sequence are maintained or are mutated to the corresponding residue of a different germline sequence. Once obtained, antibodies and antigen-binding fragments that contain one or more germline mutations can be tested for one or more desired properties such as, improved binding specificity, weak or reduced binding affinity, improved or enhanced pharmacokinetic properties, reduced immunogenicity, etc. Antibodies and antigen-binding fragments obtained in this general manner given the guidance of the present disclosure are encompassed within the present invention.

The present invention also includes anti-CD3 antibodies comprising variants of any of the HCVR, LCVR, and/or CDR amino acid sequences disclosed herein having one or more conservative substitutions. For example, the present invention includes anti-CD3 antibodies having HCVR, LCVR, and/or CDR amino acid sequences with, e.g., 10 or fewer, 8 or fewer, 6 or fewer, 4 or fewer, etc. conservative amino acid substitutions relative to any of the HCVR, LCVR, and/or CDR amino acid sequences set forth in Tables 1, 9, 11, 12, 15, and 17 herein. The antibodies and bispecific antigen-binding molecules of the present invention comprise one or more amino acid substitutions, insertions and/or deletions in the framework and/or CDR regions of the heavy and light chain variable domains as compared to the corresponding germline sequences from which the individual antigen-binding domains were derived, while maintaining or improving the desired weak-to-no detectable binding to CD3 antigen. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein, i.e. the amino acid substitution maintains or improves the desired weak to no detectable binding affinity in the case of anti-CD3 binding molecules. Examples of groups of amino acids that have side chains with similar chemical properties include (1) aliphatic side chains: glycine, alanine, valine, leucine and isoleucine; (2) aliphatic-hydroxyl side chains: serine and threonine; (3) amide-containing side chains: asparagine and glutamine; (4) aromatic side chains: phenylalanine, tyrosine, and tryptophan; (5) basic side chains: lysine, arginine, and histidine; (6) acidic side chains: aspartate and glutamate, and (7) sulfur-containing side chains are cysteine and methionine. Preferred conservative amino acids substitution groups are: valine-leucine-isoleucine, phenylalanine-tyrosine, lysine-arginine, alanine-valine, glutamate-aspartate, and asparagine-glutamine. Alternatively, a conservative replacement is any change having a positive value in the PAM250 log-likelihood matrix disclosed in Gonnet et al. (1992) Science 256: 1443-1445. A "moderately conservative" replacement is any change having a nonnegative value in the PAM250 log-likelihood matrix.

The present invention also includes antigen-binding molecules comprising an antigen-binding domain with an HCVR and/or CDR amino acid sequence that is substantially identical to any of the HCVR and/or CDR amino acid sequences disclosed herein, while maintaining or improving the desired weak affinity to CD3 antigen. The term "substantial identity" or "substantially identical," when referring to an amino acid sequence means that two amino acid sequences, when optimally aligned, such as by the programs GAP or BESTFIT using default gap weights, share at least 95% sequence identity, even more preferably at least 98% or 99% sequence identity. Preferably, residue positions which are not identical differ by conservative amino acid substitutions. In cases where two or more amino acid sequences differ from each other by conservative substitutions, the percent sequence identity or degree of similarity may be adjusted upwards to correct for the conservative nature of the substitution. Means for making this adjustment are well-known to those of skill in the art. See, e.g., Pearson (1994) Methods Mol. Biol. 24: 307-331.

Sequence similarity for polypeptides, which is also referred to as sequence identity, is typically measured using sequence analysis software. Protein analysis software matches similar sequences using measures of similarity assigned to various substitutions, deletions and other modifications, including conservative amino acid substitutions. For instance, GCG software contains programs such as Gap and Bestfit which can be used with default parameters to determine sequence homology or sequence identity between closely related polypeptides, such as homologous polypeptides from different species of organisms or between a wild type protein and a mutein thereof. See, e.g., GCG Version 6.1. Polypeptide sequences also can be compared using FASTA using default or recommended parameters, a program in GCG Version 6.1. FASTA (e.g., FASTA2 and FASTA3) provides alignments and percent sequence identity of the regions of the best overlap between the query and search sequences (Pearson (2000) supra). Another preferred algorithm when comparing a sequence of the invention to a database containing a large number of sequences from different organisms is the computer program BLAST, especially BLASTP or TBLASTN, using default parameters. See, e.g., Altschul et al. (1990) J. Mol. Biol. 215:403-410 and Altschul et al. (1997) Nucleic Acids Res. 25:3389-402.

Once obtained, antigen-binding domains that contain one or more germline mutations were tested for decreased binding affinity utilizing one or more in vitro assays. Although antibodies that recognize a particular antigen are typically screened for their purpose by testing for high (i.e. strong) binding affinity to the antigen, the antibodies of the present invention exhibit weak binding or no detectable binding. Bispecific antigen-binding molecules comprising one or more antigen-binding domains obtained in this general manner are also encompassed within the present invention and were found to be advantageous as avidity-driven tumor therapies.

Unexpected benefits, for example, improved pharmacokinetic properties and low toxicity to the patient may be realized from the methods described herein.

Binding Properties of the Antibodies

As used herein, the term "binding" in the context of the binding of an antibody, immunoglobulin, antibody-binding fragment, or Fc-containing protein to either, e.g., a predetermined antigen, such as a cell surface protein or fragment thereof, typically refers to an interaction or association between a minimum of two entities or molecular structures, such as an antibody-antigen interaction.

For instance, binding affinity typically corresponds to a $K_D$ value of about $10^{-7}$ M or less, such as about $10^{-8}$ M or less, such as about $10^{-9}$ M or less when determined by, for instance, surface plasmon resonance (SPR) technology in a BIAcore 3000 instrument using the antigen as the ligand and the antibody, Ig, antibody-binding fragment, or Fc-containing protein as the analyte (or antiligand). Cell-based binding strategies, such as fluorescent-activated cell sorting (FACS) binding assays, are also routinely used, and FACS data correlates well with other methods such as radioligand competition binding and SPR (Benedict, C A, *J Immunol Methods*. 1997, 201(2):223-31; Geuijen, C A, et al. *J Immunol Methods*. 2005, 302(1-2):68-77).

Accordingly, the antibody or antigen-binding protein of the invention binds to the predetermined antigen or cell surface molecule (receptor) having an affinity corresponding to a $K_D$ value that is at least ten-fold lower than its affinity for binding to a non-specific antigen (e.g., BSA, casein). According to the present invention, the affinity of an antibody corresponding to a $K_D$ value that is equal to or less than ten-fold lower than a non-specific antigen may be considered non-detectable binding, however such an antibody may be paired with a second antigen binding arm for the production of a bispecific antibody of the invention.

The term "$K_D$" (M) refers to the dissociation equilibrium constant of a particular antibody-antigen interaction, or the dissociation equilibrium constant of an antibody or antibody-binding fragment binding to an antigen. There is an inverse relationship between $K_D$ and binding affinity, therefore the smaller the $K_D$ value, the higher, i.e. stronger, the affinity. Thus, the terms "higher affinity" or "stronger affinity" relate to a higher ability to form an interaction and therefore a smaller $K_D$ value, and conversely the terms "lower affinity" or "weaker affinity" relate to a lower ability to form an interaction and therefore a larger $K_D$ value. In some circumstances, a higher binding affinity (or $K_D$) of a particular molecule (e.g. antibody) to its interactive partner molecule (e.g. antigen X) compared to the binding affinity of the molecule (e.g. antibody) to another interactive partner molecule (e.g. antigen Y) may be expressed as a binding ratio determined by dividing the larger $K_D$ value (lower, or weaker, affinity) by the smaller $K_D$ (higher, or stronger, affinity), for example expressed as 5-fold or 10-fold greater binding affinity, as the case may be.

The term "$k_d$" (sec−1 or 1/s) refers to the dissociation rate constant of a particular antibody-antigen interaction, or the dissociation rate constant of an antibody or antibody-binding fragment. Said value is also referred to as the $k_{off}$ value.

The term "$k_a$" (M−1×sec−1 or 1/M) refers to the association rate constant of a particular antibody-antigen interaction, or the association rate constant of an antibody or antibody-binding fragment.

The term "$K_A$" (M−1 or 1/M) refers to the association equilibrium constant of a particular antibody-antigen interaction, or the association equilibrium constant of an antibody or antibody-binding fragment. The association equilibrium constant is obtained by dividing the $k_a$ by the $k_d$.

The term "EC50" or "$EC_{50}$" refers to the half maximal effective concentration, which includes the concentration of an antibody which induces a response halfway between the baseline and maximum after a specified exposure time. The $EC_{50}$ essentially represents the concentration of an antibody where 50% of its maximal effect is observed. In certain embodiments, the $EC_{50}$ value equals the concentration of an antibody of the invention that gives half-maximal binding to cells expressing CD3 or tumor-associated antigen, as determined by e.g. a FACS binding assay. Thus, reduced or weaker binding is observed with an increased $EC_{50}$, or half maximal effective concentration value.

In one embodiment, decreased binding can be defined as an increased $EC_{50}$ antibody concentration which enables binding to the half-maximal amount of target cells.

In another embodiment, the $EC_{50}$ value represents the concentration of an antibody of the invention that elicits half-maximal depletion of target cells by T cell cytotoxic activity. Thus, increased cytotoxic activity (e.g. T cell-mediated tumor cell killing) is observed with a decreased $EC_{50}$, or half maximal effective concentration value.

Bispecific Antigen-Binding Molecules

The antibodies of the present invention may be monospecific, bi-specific, or multispecific. Multispecific antibodies may be specific for different epitopes of one target polypeptide or may contain antigen-binding domains specific for more than one target polypeptide. See, e.g., Tutt et al., 1991, J. Immunol. 147:60-69; Kufer et al., 2004, Trends Biotechnol. 22:238-244. The anti-STEAP2 monospecific antibodies or anti-STEAP2/anti-CD3 bispecific antibodies of the present invention can be linked to or co-expressed with another functional molecule, e.g., another peptide or protein. For example, an antibody or fragment thereof can be functionally linked (e.g., by chemical coupling, genetic fusion, noncovalent association or otherwise) to one or more other molecular entities, such as another antibody or antibody fragment to produce a bi-specific or a multispecific antibody with a second or additional binding specificity.

Use of the expression "anti-CD3 antibody" or "anti-STEAP2 antibody" herein is intended to include both monospecific anti-CD3 or anti-STEAP2 antibodies as well as bispecific antibodies comprising a CD3-binding arm and a STEAP2-binding arm. Thus, the present invention includes bispecific antibodies wherein one arm of an immunoglobulin binds human CD3, and the other arm of the immunoglobulin is specific for human STEAP2. The CD3-binding arm can comprise any of the HCVR/LCVR or CDR amino acid sequences as set forth in Tables 1, 9, 11, 12, 15, and 17 herein.

In certain embodiments, the CD3-binding arm binds to human CD3 and induces human T cell activation. In certain embodiments, the CD3-binding arm binds weakly to human CD3 and induces human T cell activation. In other embodiments, the CD3-binding arm binds weakly to human CD3 and induces tumor-associated antigen-expressing cell killing in the context of a bispecific or multispecific antibody. In other embodiments, the CD3-binding arm binds or associated weakly with human and cynomolgus (monkey) CD3, yet the binding interaction is not detectable by in vitro assays known in the art. The STEAP2-binding arm can comprise any of the HCVR/LCVR or CDR amino acid sequences as set forth in Table 1 herein.

According to certain exemplary embodiments, the present invention includes bispecific antigen-binding molecules that specifically bind CD3 and STEAP2. Such molecules may be referred to herein as, e.g., "anti-CD3/anti-STEAP2," or "anti-CD3×STEAP2" or "CD3×STEAP2" bispecific molecules, or other similar terminology (e.g., anti-STEAP2/anti-CD3).

The term "STEAP2," as used herein, refers to the human STEAP2 protein unless specified as being from a non-human species (e.g., "mouse STEAP2," "monkey STEAP2," etc.). The human STEAP2 protein has the amino acid sequence shown in SEQ ID NO:1899.

The aforementioned bispecific antigen-binding molecules that specifically bind CD3 and STEAP2 may comprise an anti-CD3 antigen-binding molecule which binds to CD3 with a weak binding affinity such as exhibiting a $K_D$ of greater than about 40 nM, as measured by an in vitro affinity binding assay. In some cases, the CD3 binding arm binds CD3 with a $K_D$ or $EC_{50}$ greater than about 100 nM, greater than about 200 nM, greater than about 300 nM, greater than about 400 nM, greater than about 500 nM, or greater than about 1 µM (e.g., as measures in a surface plasmon resonance assay). In some cases, the first antigen-binding domain specifically binds CD3 (e.g., either or both of human CD3 and cynomolgus CD3 with weak or no measurable affinity).

As used herein, the expression "antigen-binding molecule" means a protein, polypeptide or molecular complex comprising or consisting of at least one complementarity determining region (CDR) that alone, or in combination with one or more additional CDRs and/or framework regions (FRs), specifically binds to a particular antigen. In certain embodiments, an antigen-binding molecule is an antibody or a fragment of an antibody, as those terms are defined elsewhere herein.

As used herein, the expression "bispecific antigen-binding molecule" means a protein, polypeptide or molecular complex comprising at least a first antigen-binding domain and a second antigen-binding domain. Each antigen-binding domain within the bispecific antigen-binding molecule comprises at least one CDR that alone, or in combination with one or more additional CDRs and/or FRs, specifically binds to a particular antigen. In the context of the present invention, the first antigen-binding domain specifically binds a first antigen (e.g., CD3), and the second antigen-binding domain specifically binds a second, distinct antigen (e.g., STEAP2).

In certain exemplary embodiments of the present invention, the bispecific antigen-binding molecule is a bispecific antibody. Each antigen-binding domain of a bispecific antibody comprises a heavy chain variable domain (HCVR) and a light chain variable domain (LCVR). In the context of a bispecific antigen-binding molecule comprising a first and a second antigen-binding domain (e.g., a bispecific antibody), the CDRs of the first antigen-binding domain may be designated with the prefix "A1" and the CDRs of the second antigen-binding domain may be designated with the prefix "A2". Thus, the CDRs of the first antigen-binding domain may be referred to herein as A1-HCDR1, A1-HCDR2, and A1-HCDR3; and the CDRs of the second antigen-binding domain may be referred to herein as A2-HCDR1, A2-HCDR2, and A2-HCDR3.

The first antigen-binding domain and the second antigen-binding domain may be directly or indirectly connected to one another to form a bispecific antigen-binding molecule of the present invention. Alternatively, the first antigen-binding domain and the second antigen-binding domain may each be connected to a separate multimerizing domain. The association of one multimerizing domain with another multimerizing domain facilitates the association between the two antigen-binding domains, thereby forming a bispecific antigen-binding molecule. As used herein, a "multimerizing domain" is any macromolecule, protein, polypeptide, peptide, or amino acid that has the ability to associate with a second multimerizing domain of the same or similar structure or constitution. For example, a multimerizing domain may be a polypeptide comprising an immunoglobulin $C_H3$ domain. A non-limiting example of a multimerizing component is an Fc portion of an immunoglobulin (comprising a $C_H2$-$C_H3$ domain), e.g., an Fc domain of an IgG selected from the isotypes IgG1, IgG2, IgG3, and IgG4, as well as any allotype within each isotype group.

Bispecific antigen-binding molecules of the present invention will typically comprise two multimerizing domains, e.g., two Fc domains that are each individually part of a separate antibody heavy chain. The first and second multimerizing domains may be of the same IgG isotype such as, e.g., IgG1/IgG1, IgG2/IgG2, IgG4/IgG4. Alternatively, the first and second multimerizing domains may be of different IgG isotypes such as, e.g., IgG1/IgG2, IgG1/IgG4, IgG2/IgG4, etc.

In certain embodiments, the multimerizing domain is an Fc fragment or an amino acid sequence of from 1 to about 200 amino acids in length containing at least one cysteine residue. In other embodiments, the multimerizing domain is a cysteine residue, or a short cysteine-containing peptide. Other multimerizing domains include peptides or polypeptides comprising or consisting of a leucine zipper, a helix-loop motif, or a coiled-coil motif.

Any bispecific antibody format or technology may be used to make the bispecific antigen-binding molecules of the present invention. For example, an antibody or fragment thereof having a first antigen binding specificity can be functionally linked (e.g., by chemical coupling, genetic fusion, noncovalent association or otherwise) to one or more other molecular entities, such as another antibody or antibody fragment having a second antigen-binding specificity to produce a bispecific antigen-binding molecule. Specific exemplary bispecific formats that can be used in the context of the present invention include, without limitation, e.g., scFv-based or diabody bispecific formats, IgG-scFv fusions, dual variable domain (DVD)-Ig, Quadroma, knobs-into-holes, common light chain (e.g., common light chain with knobs-into-holes, etc.), CrossMab, CrossFab, (SEED) body, leucine zipper, Duobody, IgG1/IgG2, dual acting Fab (DAF)-IgG, and Mab$^2$ bispecific formats (see, e.g., Klein et al. 2012, mAbs 4:6, 1-11, and references cited therein, for a review of the foregoing formats).

In the context of bispecific antigen-binding molecules of the present invention, the multimerizing domains, e.g., Fc domains, may comprise one or more amino acid changes (e.g., insertions, deletions or substitutions) as compared to the wild-type, naturally occurring version of the Fc domain. For example, the invention includes bispecific antigen-binding molecules comprising one or more modifications in the Fc domain that results in a modified Fc domain having a modified binding interaction (e.g., enhanced or diminished) between Fc and FcRn. In one embodiment, the bispecific antigen-binding molecule comprises a modification in a $C_H2$ or a $C_H3$ region, wherein the modification increases the affinity of the Fc domain to FcRn in an acidic environment (e.g., in an endosome where pH ranges from about 5.5 to about 6.0). Non-limiting examples of such Fc modifications include, e.g., a modification at position 250 (e.g., E or Q); 250 and 428 (e.g., L or F); 252 (e.g., L/Y/F/W or T), 254 (e.g., S or T), and 256 (e.g., S/R/Q/E/D or T); or a modification at position 428 and/or 433 (e.g., L/R/S/P/Q or K) and/or 434 (e.g., H/F or Y); or a modification at position 250 and/or 428; or a modification at position 307 or 308 (e.g., 308F, V308F), and 434. In one embodiment, the modification comprises a 428L (e.g., M428L) and 434S (e.g., N434S) modification; a 428L, 259I (e.g., V259I), and 308F (e.g., V308F) modification; a 433K (e.g., H433K) and a 434 (e.g., 434Y) modification; a 252, 254, and 256 (e.g., 252Y, 254T, and 256E) modification; a 250Q and 428L modification (e.g., T250Q and M428L); and a 307 and/or 308 modification (e.g., 308F or 308P).

The present invention also includes bispecific antigen-binding molecules comprising a first $C_H3$ domain and a second Ig $C_H3$ domain, wherein the first and second Ig $C_H3$ domains differ from one another by at least one amino acid, and wherein at least one amino acid difference reduces binding of the bispecific antibody to Protein A as compared to a bi-specific antibody lacking the amino acid difference. In one embodiment, the first Ig $C_H3$ domain binds Protein A and the second Ig $C_H3$ domain contains a mutation that reduces or abolishes Protein A binding such as an H95R modification (by IMGT exon numbering; H435R by EU numbering). The second $C_H3$ may further comprise a Y96F modification (by IMGT; Y436F by EU). See, for example, U.S. Pat. No. 8,586,713. Further modifications that may be found within the second $C_H3$ include: D16E, L18M, N44S, K52N, V57M, and V82I (by IMGT; D356E, L358M, N384S, K392N, V397M, and V422I by EU) in the case of IgG1 antibodies; N44S, K52N, and V82I (IMGT; N384S, K392N, and V422I by EU) in the case of IgG2 antibodies; and Q15R, N44S, K52N, V57M, R69K, E79Q, and V82I (by IMGT; Q355R, N384S, K392N, V397M, R409K, E419Q, and V422I by EU) in the case of IgG4 antibodies.

In certain embodiments, the Fc domain may be chimeric, combining Fc sequences derived from more than one immunoglobulin isotype. For example, a chimeric Fc domain can comprise part or all of a $C_H2$ sequence derived from a human IgG1, human IgG2 or human IgG4 $C_H2$ region, and part or all of a $C_H3$ sequence derived from a human IgG1, human IgG2 or human IgG4. A chimeric Fc domain can also contain a chimeric hinge region. For example, a chimeric hinge may comprise an "upper hinge" sequence, derived from a human IgG1, a human IgG2 or a human IgG4 hinge region, combined with a "lower hinge" sequence, derived from a human IgG1, a human IgG2 or a human IgG4 hinge region. A particular example of a chimeric Fc domain that can be included in any of the antigen-binding molecules set forth herein comprises, from N- to C-terminus: [IgG4 $C_H1$]-[IgG4 upper hinge]-[IgG2 lower hinge]-[IgG4 CH2]-[IgG4 CH3]. Another example of a chimeric Fc domain that can be included in any of the antigen-binding molecules set forth herein comprises, from N- to C-terminus: [IgG1 CH1]-[IgG1 upper hinge]-[IgG2 lower hinge]-[IgG4 CH2]-[IgG1 CH3]. These and other examples of chimeric Fc domains that can be included in any of the antigen-binding molecules of the present invention are described in US Publication 2014/0243504, published Aug. 28, 2014, which is herein incorporated in its entirety. Chimeric Fc domains having these general structural arrangements, and variants thereof, can have altered Fc receptor binding, which in turn affects Fc effector function.

In certain embodiments, the invention provides an antibody heavy chain wherein the heavy chain constant region (CH) region comprises an amino acid sequence at least 95%, at least 96%, at least 97%, at least 98%, at least 99% identical to any one of SEQ ID NO: 1911, SEQ ID NO: 1912, SEQ ID NO: 1913, SEQ ID NO: 1914, SEQ ID NO: 1915, SEQ ID NO: 1916, SEQ ID NO: 1917, SEQ ID NO: 1918, SEQ ID NO: 1919 or SEQ ID NO: 1920. In some embodiments, the heavy chain constant region (CH) region comprises an amino acid sequence selected from the group consisting of SEQ ID NO: 1911, SEQ ID NO: 1912, SEQ ID NO: 1913, SEQ ID NO: 1914, SEQ ID NO: 1915, SEQ ID NO: 1916, SEQ ID NO: 1917, SEQ ID NO: 1918, SEQ ID NO: 1919 and SEQ ID NO: 1920.

In other embodiments, the invention provides an antibody heavy chain wherein the Fc domain comprises an amino acid sequence at least 95%, at least 96%, at least 97%, at least 98%, at least 99% identical to any one of SEQ ID NO: 1921, SEQ ID NO: 1922, SEQ ID NO: 1923 SEQ ID NO: 1924 SEQ ID NO: 1925, SEQ ID NO: 1926, SEQ ID NO: 1927, SEQ ID NO: 1928, SEQ ID NO: 1929 or SEQ ID NO: 1930. In some embodiments, the Fc domain comprises an amino acid sequence selected form the group consisting of SEQ ID NO: 1921, SEQ ID NO: 1922, SEQ ID NO: 1923 SEQ ID NO: 1924 SEQ ID NO: 1925, SEQ ID NO: 1926, SEQ ID NO: 1927, SEQ ID NO: 1928, SEQ ID NO: 1929 and SEQ ID NO: 1930.

Sequence Variants

The antibodies and bispecific antigen-binding molecules of the present invention may comprise one or more amino acid substitutions, insertions and/or deletions in the framework and/or CDR regions of the heavy and light chain variable domains as compared to the corresponding germline sequences from which the individual antigen-binding domains were derived. Such mutations can be readily ascertained by comparing the amino acid sequences disclosed herein to germline sequences available from, for example, public antibody sequence databases. The antigen-binding molecules of the present invention may comprise antigen-binding domains which are derived from any of the exemplary amino acid sequences disclosed herein, wherein one or more amino acids within one or more framework and/or CDR regions are mutated to the corresponding residue(s) of the germline sequence from which the antibody was derived, or to the corresponding residue(s) of another human germline sequence, or to a conservative amino acid substitution of the corresponding germline residue(s) (such sequence changes are referred to herein collectively as "germline mutations"). A person of ordinary skill in the art, starting with the heavy and light chain variable region sequences disclosed herein, can easily produce numerous antibodies and antigen-binding fragments which comprise one or more individual germline mutations or combinations thereof. In certain embodiments, all of the framework and/or CDR residues within the $V_H$ and/or $V_L$ domains are mutated back to the residues found in the original germline sequence from which the antigen-binding domain was originally derived. In other embodiments, only certain residues are mutated back to the original germline sequence, e.g., only the mutated residues found within the first 8 amino acids of FR1 or within the last 8 amino acids of FR4, or only the mutated residues found within CDR1, CDR2 or CDR3. In other embodiments, one or more of the framework and/or CDR residue(s) are mutated to the corresponding residue(s) of a different germline sequence (i.e., a germline sequence that is different from the germline sequence from which the antigen-binding domain was originally derived). Furthermore, the antigen-binding domains may contain any combination of two or more germline mutations within the framework and/or CDR regions, e.g., wherein certain individual residues are mutated to the corresponding residue of a particular germline sequence while certain other residues that differ from the original germline sequence are maintained or are mutated to the corresponding residue of a different germline sequence. Once obtained, antigen-binding domains that contain one or more germline mutations can be easily tested for one or more desired property such as, improved binding specificity, increased binding affinity, improved or enhanced antagonistic or agonistic biological properties (as the case may be), reduced immunogenicity, etc. Bispecific antigen-binding molecules comprising one or more antigen-binding domains obtained in this general manner are encompassed within the present invention.

The present invention also includes antigen-binding molecules wherein one or both antigen-binding domains comprise variants of any of the HCVR, LCVR, and/or CDR amino acid sequences disclosed herein having one or more conservative substitutions. For example, the present invention includes antigen-binding molecules comprising an antigen-binding domain having HCVR, LCVR, and/or CDR amino acid sequences with, e.g., 10 or fewer, 8 or fewer, 6 or fewer, 4 or fewer, etc. conservative amino acid substitutions relative to any of the HCVR, LCVR, and/or CDR amino acid sequences disclosed herein. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein. Examples of groups of amino acids that have side chains with similar chemical properties include (1) aliphatic side chains: glycine, alanine, valine, leucine and isoleucine; (2) aliphatic-hydroxyl side chains: serine and threonine; (3) amide-containing side chains: asparagine and glutamine; (4) aromatic side chains: phenylalanine, tyrosine, and tryptophan; (5) basic side chains: lysine, arginine, and histidine; (6) acidic side chains: aspartate and glutamate, and (7) sulfur-containing side chains are cysteine and methionine. Preferred conservative amino acids substitution groups are: valine-leucine-isoleucine, phenylalanine-tyrosine, lysine-arginine, alanine-valine, glutamate-aspartate, and asparagine-glutamine. Alternatively, a conservative replacement is any change having a positive value in the PAM250 log-likelihood matrix disclosed in Gonnet et al.

(1992) Science 256: 1443-1445, herein incorporated by reference. A "moderately conservative" replacement is any change having a nonnegative value in the PAM250 log-likelihood matrix.

The present invention also includes antigen-binding molecules comprising an antigen-binding domain with an HCVR, LCVR, and/or CDR amino acid sequence that is substantially identical to any of the HCVR, LCVR, and/or CDR amino acid sequences disclosed herein. The term "substantial identity" or "substantially identical," when referring to an amino acid sequence means that two amino acid sequences, when optimally aligned, such as by the programs GAP or BESTFIT using default gap weights, share at least 95% sequence identity, even more preferably at least 98% or 99% sequence identity. Preferably, residue positions which are not identical differ by conservative amino acid substitutions. In cases where two or more amino acid sequences differ from each other by conservative substitutions, the percent sequence identity or degree of similarity may be adjusted upwards to correct for the conservative nature of the substitution. Means for making this adjustment are well-known to those of skill in the art. See, e.g., Pearson (1994) Methods Mol. Biol. 24: 307-331, herein incorporated by reference.

Sequence similarity for polypeptides, which is also referred to as sequence identity, is typically measured using sequence analysis software. Protein analysis software matches similar sequences using measures of similarity assigned to various substitutions, deletions and other modifications, including conservative amino acid substitutions. For instance, GCG software contains programs such as Gap and Bestfit which can be used with default parameters to determine sequence homology or sequence identity between closely related polypeptides, such as homologous polypeptides from different species of organisms or between a wild type protein and a mutein thereof. See, e.g., GCG Version 6.1. Polypeptide sequences also can be compared using FASTA using default or recommended parameters, a program in GCG Version 6.1. FASTA (e.g., FASTA2 and FASTA3) provides alignments and percent sequence identity of the regions of the best overlap between the query and search sequences (Pearson (2000) supra). Another preferred algorithm when comparing a sequence of the invention to a database containing a large number of sequences from different organisms is the computer program BLAST, especially BLASTP or TBLASTN, using default parameters. See, e.g., Altschul et al. (1990) J. Mol. Biol. 215:403-410 and Altschul et al. (1997) Nucleic Acids Res. 25:3389-402, each herein incorporated by reference.

pH-Dependent Binding

The present invention includes anti-STEAP2 antibodies, and anti-CD3/anti-STEAP2 bispecific antigen-binding molecules, with pH-dependent binding characteristics. For example, an anti-STEAP2 antibody of the present invention may exhibit reduced binding to STEAP2 at acidic pH as compared to neutral pH. Alternatively, anti-STEAP2 antibodies of the invention may exhibit enhanced binding to STEAP2 at acidic pH as compared to neutral pH. The expression "acidic pH" includes pH values less than about 6.2, e.g., about 6.0, 5.95, 5.9, 5.85, 5.8, 5.75, 5.7, 5.65, 5.6, 5.55, 5.5, 5.45, 5.4, 5.35, 5.3, 5.25, 5.2, 5.15, 5.1, 5.05, 5.0, or less. As used herein, the expression "neutral pH" means a pH of about 7.0 to about 7.4. The expression "neutral pH" includes pH values of about 7.0, 7.05, 7.1, 7.15, 7.2, 7.25, 7.3, 7.35, and 7.4.

In certain instances, "reduced binding . . . at acidic pH as compared to neutral pH" is expressed in terms of a ratio of the $K_D$ value of the antibody binding to its antigen at acidic pH to the $K_D$ value of the antibody binding to its antigen at neutral pH (or vice versa). For example, an antibody or antigen-binding fragment thereof may be regarded as exhibiting "reduced binding to STEAP2 at acidic pH as compared to neutral pH" for purposes of the present invention if the antibody or antigen-binding fragment thereof exhibits an acidic/neutral $K_D$ ratio of about 3.0 or greater. In certain exemplary embodiments, the acidic/neutral $K_D$ ratio for an antibody or antigen-binding fragment of the present invention can be about 3.0, 3.5, 4.0, 4.5, 5.0, 5.5, 6.0, 6.5, 7.0, 7.5, 8.0, 8.5, 9.0, 9.5, 10.0, 10.5, 11.0, 11.5, 12.0, 12.5, 13.0, 13.5, 14.0, 14.5, 15.0, 20.0, 25.0, 30.0, 40.0, 50.0, 60.0, 70.0, 100.0 or greater.

Antibodies with pH-dependent binding characteristics may be obtained, e.g., by screening a population of antibodies for reduced (or enhanced) binding to a particular antigen at acidic pH as compared to neutral pH. Additionally, modifications of the antigen-binding domain at the amino acid level may yield antibodies with pH-dependent characteristics. For example, by substituting one or more amino acids of an antigen-binding domain (e.g., within a CDR) with a histidine residue, an antibody with reduced antigen-binding at acidic pH relative to neutral pH may be obtained.

Antibodies Comprising Fc Variants

According to certain embodiments of the present invention, anti-STEAP2 antibodies, and anti-CD3/anti-STEAP2 bispecific antigen-binding molecules, are provided comprising an Fc domain comprising one or more mutations which enhance or diminish antibody binding to the FcRn receptor, e.g., at acidic pH as compared to neutral pH. For example, the present invention includes antibodies comprising a mutation in the $C_H2$ or a $C_H3$ region of the Fc domain, wherein the mutation(s) increases the affinity of the Fc domain to FcRn in an acidic environment (e.g., in an endosome where pH ranges from about 5.5 to about 6.0). Such mutations may result in an increase in serum half-life of the antibody when administered to an animal. Non-limiting examples of such Fc modifications include, e.g., a modification at position 250 (e.g., E or Q); 250 and 428 (e.g., L or F); 252 (e.g., L/Y/F/W or T), 254 (e.g., S or T), and 256 (e.g., S/R/Q/E/D or T); or a modification at position 428 and/or 433 (e.g., H/L/R/S/P/Q or K) and/or 434 (e.g., H/F or Y); or a modification at position 250 and/or 428; or a modification at position 307 or 308 (e.g., 308F, V308F), and 434. In one embodiment, the modification comprises a 428L (e.g., M428L) and 434S (e.g., N434S) modification; a 428L, 259I (e.g., V259I), and 308F (e.g., V308F) modification; a 433K (e.g., H433K) and a 434 (e.g., 434Y) modification; a 252, 254, and 256 (e.g., 252Y, 254T, and 256E) modification; a 250Q and 428L modification (e.g., T250Q and M428L); and a 307 and/or 308 modification (e.g., 308F or 308P).

For example, the present invention includes anti-STEAP2 antibodies, and anti-CD3/anti-STEAP2 bispecific antigen-binding molecules, comprising an Fc domain comprising one or more pairs or groups of mutations selected from the group consisting of: 250Q and 248L (e.g., T250Q and M248L); 252Y, 254T and 256E (e.g., M252Y, S254T and T256E); 428L and 434S (e.g., M428L and N434S); and 433K and 434F (e.g., H433K and N434F). All possible combinations of the foregoing Fc domain mutations, and other mutations within the antibody variable domains disclosed herein, are contemplated within the scope of the present invention.

Biological Characteristics of the Antibodies and Bispecific Antigen-Binding Molecules The present invention includes antibodies and antigen-binding fragments thereof that bind human STEAP2 with high affinity (e.g., sub-nanomolar $K_D$ values).

The present invention also includes anti-CD3/anti-STEAP2 bispecific antigen-binding molecules which inhibit tumor growth in immunocompromised mice bearing human prostate cancer xenografts. (see, e.g., Example 5).

The present invention includes antibodies and antigen-binding fragments thereof that bind human CD3 with high affinity. The present invention also includes antibodies and antigen-binding fragments thereof that bind human CD3 with medium or low affinity, depending on the therapeutic context and particular targeting properties that are desired. For example, in the context of a bispecific antigen-binding molecule, wherein one arm binds CD3 and another arm binds a target antigen (e.g., STEAP2), it may be desirable for the target antigen-binding arm to bind the target antigen with high affinity while the anti-CD3 arm binds CD3 with only moderate or low affinity. In this manner, preferential targeting of the antigen-binding molecule to cells expressing the target antigen may be achieved while avoiding general/untargeted CD3 binding and the consequent adverse side effects associated therewith.

The present invention includes bispecific antigen-binding molecules (e.g., bispecific antibodies) which are capable of simultaneously binding to human CD3 and a human STEAP2. The binding arm that interacts with cells that express CD3 may have weak to no detectable binding as measured in a suitable in vitro binding assay. The extent to which a bispecific antigen-binding molecule binds cells that express CD3 and/or STEAP2 can be assessed by fluorescence activated cell sorting (FACS).

The present invention also includes antibodies, antigen-binding fragments, and bispecific antibodies thereof which bind to STEAP2-expressing cells and cell lines (e.g., CA-2 cells), with an $EC_{50}$ value of between about 1 nM and 50 nM, as determined using a FACS binding assay as set forth in Example 2 or a substantially similar assay. In certain embodiments, the antibodies, antigen-binding fragments, and bispecific antibodies thereof which bind to STEAP2-expressing cells and cell lines (e.g., CA-2 cells), with an $EC_{50}$ value of about 50 nM, of about 40 nM, of about 30 nM, of about 20 nM, of about of less than about 15 nM, of about 10 nM, of about 5 nM, of about 4 nM, of about 3 nM, or of about 2 nM, of about 1 nM, as determined using a FACS binding assay as set forth in Example 2 or a substantially similar assay.

The present invention includes antibodies, antigen-binding fragments, and bispecific antibodies thereof that bind human CD3 with weak (i.e. low) or even no detectable affinity. According to certain embodiments, the present invention includes antibodies and antigen-binding fragments of antibodies that bind human CD3 (e.g., at 37° C.) with a $K_D$ of greater than about 11 nM as measured by surface plasmon resonance. In certain embodiments, the antibodies or antigen-binding fragments of the present invention bind CD3 with a $K_D$ of greater than about 15 nM, greater than about 20 nM, greater than about 25 nM, greater than about 30 nM, greater than about 35 nM, greater than about 40 nM, greater than about 45 nM, greater than about 50 nM, greater than about 55 nM, greater than about 60 nM, greater than about 65 nM, greater than about 70 nM, greater than about 75 nM, at least 80 nM, greater than about 90 nM, greater than about 100 nM, greater than about 110 nM, at least 120 nM, greater than about 130 nM, greater than about 140 nM, greater than about 150 nM, at least 160 nM, greater than about 170 nM, greater than about 180 nM, greater than about 190 nM, greater than about 200 nM, greater than about 250 nM, greater than about 300 nM, greater than about 400 nM, greater than about 500 nM, or greater than about 1 μM, or with no detectable affinity, as measured by surface plasmon resonance (e.g., mAb-capture or antigen-capture format), or a substantially similar assay.

The present invention includes antibodies, antigen-binding fragments, and bispecific antibodies thereof that bind monkey (i.e. cynomolgus) CD3 with weak (i.e. low) or even no detectable affinity.

The present invention includes anti-CD3/anti-STEAP2 bispecific antigen-binding molecules which bind to and are internalized by human STEAP2 expressing cells (e.g., CA-2 cells), as measured by an assay format as defined by Example 3 herein or a substantially similar assay. The present invention includes anti-CD3/anti-STEAP2 bispecific antigen-binding molecules which are specific for binding to human STEAP2. In certain embodiments, the anti-CD3/anti-STEAP2 bispecific antigen-binding molecules of the present invention bind human STEAP-2 transiently expressed in HEK293 cells, as measured by an assay format as defined by Example 3 herein or a substantially similar assay. In certain embodiments, the anti-CD3/anti-STEAP2 bispecific antigen-binding molecules of the present invention do not bind human STEAP1, human STEAP2, or human STEAP4 transiently expressed in HEK293 cells, as measured by an assay format as defined by Example 3 herein or a substantially similar assay.

The present invention includes anti-CD3/anti-STEAP2 bispecific antigen-binding molecules which are capable of inhibiting C4-2 tumor growth (see, e.g., Example 5). For example, according to certain embodiments, anti-CD3/anti-STEAP2 bispecific antigen-binding molecules are provided, wherein a single administration e.g., at a dose of about 0.1 mg/kg or about 0.01 mg/kg) causes a reduction in the tumor size compared to animals administered a isotype control bispecific antibody, when measured 46 days post-tumor implantation, as detected in a subject using standard caliper measurement methods, e.g., as set forth in Example 5, herein.

The present invention also includes anti-STEAP2 antibody drug conjugates which inhibit tumor growth in in vivo STEAP2 positive prostate cancer xenograft models (see, e.g., Example 7, or in a substantially similar assay). In certain embodiments, anti-STEAP2 antibody drug conjugates with Compound 7 are provided, wherein one dose at 10, 20, or 40 mg/kg administered on day 13 after tumor implantation, inhibit C4-2 tumor growth in in vivo STEAP2 positive prostate cancer xenograft models. In certain embodiments, anti-STEAP2 antibody drug conjugates with Compound 7 are provided wherein one dose at 5 or 20 mg/kg administered on day 14 after implantation, inhibit C4-2 tumor growth in in vivo STEAP2 positive prostate cancer xenograft models. In certain embodiments, anti-STEAP2 antibody drug conjugates with Compound 7 are provided wherein one dose at 150 μg/kg administered on day 17 after implantation, inhibit C4-2 tumor growth in in vivo STEAP2 positive prostate cancer xenograft models. In other embodiments, anti-STEAP2 antibody drug conjugates with Compound 60 are provided wherein one dose of at least 2.5 mg/kg administered on day 29 after implantation, inhibits C4-2 tumor growth in in vivo STEAP2 positive prostate cancer xenograft models.

Epitope Mapping and Related Technologies

The epitope on CD3 and/or STEAP2 to which the antigen-binding molecules of the present invention bind may consist of a single contiguous sequence of 3 or more (e.g., 3, 4, 5, 6, 7, 8, 9, 10, 11, 12, 13, 14, 15, 16, 17, 18, 19, 20 or more) amino acids of a CD3 or STEAP2 protein. Alternatively, the epitope may consist of a plurality of non-contiguous amino acids (or amino acid sequences) of CD3 or STEAP2. The antibodies of the invention may interact with amino acids contained within a single CD3 chain (e.g., CD3-epsilon, CD3-delta or CD3-gamma), or may interact with amino acids on two or more different CD3 chains. The term "epitope," as used herein, refers to an antigenic determinant that interacts with a specific antigen binding site in the variable region of an antibody molecule known as a paratope. A single antigen may have more than one epitope. Thus, different antibodies may bind to different areas on an antigen and may have different biological effects. Epitopes may be either conformational or linear. A conformational epitope is produced by spatially juxtaposed amino acids from different segments of the linear polypeptide chain. A linear epitope is one produced by adjacent amino acid residues in a polypeptide chain. In certain circumstances, an epitope may include moieties of saccharides, phosphoryl groups, or sulfonyl groups on the antigen.

Various techniques known to persons of ordinary skill in the art can be used to determine whether an antigen-binding domain of an antibody "interacts with one or more amino acids" within a polypeptide or protein. Exemplary techniques include, e.g., routine cross-blocking assay such as that described *Antibodies*, Harlow and Lane (Cold Spring Harbor Press, Cold Spring Harb., N.Y.), alanine scanning mutational analysis, peptide blots analysis (Reineke, 2004, Methods Mol Biol 248:443-463), and peptide cleavage analysis. In addition, methods such as epitope excision, epitope extraction and chemical modification of antigens can be employed (Tomer, 2000, Protein Science 9:487-496). Another method that can be used to identify the amino acids within a polypeptide with which an antigen-binding domain of an antibody interacts is hydrogen/deuterium exchange detected by mass spectrometry. In general terms, the hydrogen/deuterium exchange method involves deuterium-labeling the protein of interest, followed by binding the antibody to the deuterium-labeled protein. Next, the protein/antibody complex is transferred to water to allow hydrogen-deuterium exchange to occur at all residues except for the residues protected by the antibody (which remain deuterium-labeled). After dissociation of the antibody, the target protein is subjected to protease cleavage and mass spectrometry analysis, thereby revealing the deuterium-labeled residues which correspond to the specific amino acids with which the antibody interacts. See, e.g., Ehring (1999) *Analytical Biochemistry* 267(2):252-259; Engen and Smith (2001) *Anal. Chem.* 73:256A-265A. X-ray crystallography of the antigen/antibody complex may also be used for epitope mapping purposes.

The present invention further includes anti-STEAP2 antibodies that bind to the same epitope as any of the specific exemplary antibodies described herein (e.g. antibodies comprising any of the amino acid sequences as set forth in Table 1 herein). Likewise, the present invention also includes anti-STEAP2 antibodies that compete for binding to STEAP2 with any of the specific exemplary antibodies described herein (e.g. antibodies comprising any of the amino acid sequences as set forth in Table 1 herein).

The present invention also includes bispecific antigen-binding molecules comprising a first antigen-binding domain that specifically binds human CD3 and/or cynomolgus CD3 with low or detectable binding affinity, and a second antigen binding domain that specifically binds human STEAP2, wherein the first antigen-binding domain binds to the same epitope on CD3 as any of the specific exemplary CD3-specific antigen-binding domains described herein, and/or wherein the second antigen-binding domain binds to the same epitope on STEAP2 as any of the specific exemplary STEAP2-specific antigen-binding domains described herein.

Likewise, the present invention also includes bispecific antigen-binding molecules comprising a first antigen-binding domain that specifically binds human CD3, and a second antigen binding domain that specifically binds human STEAP2, wherein the first antigen-binding domain competes for binding to CD3 with any of the specific exemplary CD3-specific antigen-binding domains described herein, and/or wherein the second antigen-binding domain competes for binding to STEAP2 with any of the specific exemplary STEAP2-specific antigen-binding domains described herein.

One can easily determine whether a particular antigen-binding molecule (e.g., antibody) or antigen-binding domain thereof binds to the same epitope as, or competes for binding with, a reference antigen-binding molecule of the present invention by using routine methods known in the art. For example, to determine if a test antibody binds to the same epitope on STEAP2 (or CD3) as a reference bispecific antigen-binding molecule of the present invention, the reference bispecific molecule is first allowed to bind to a STEAP2 protein (or CD3 protein). Next, the ability of a test antibody to bind to the STEAP2 (or CD3) molecule is assessed. If the test antibody is able to bind to STEAP2 (or CD3) following saturation binding with the reference bispecific antigen-binding molecule, it can be concluded that the test antibody binds to a different epitope of STEAP2 (or CD3) than the reference bispecific antigen-binding molecule. On the other hand, if the test antibody is not able to bind to the STEAP2 (or CD3) molecule following saturation binding with the reference bispecific antigen-binding molecule, then the test antibody may bind to the same epitope of STEAP2 (or CD3) as the epitope bound by the reference bispecific antigen-binding molecule of the invention. Additional routine experimentation (e.g., peptide mutation and binding analyses) can then be carried out to confirm whether the observed lack of binding of the test antibody is in fact due to binding to the same epitope as the reference bispecific antigen-binding molecule or if steric blocking (or another phenomenon) is responsible for the lack of observed binding. Experiments of this sort can be performed using ELISA, RIA, Biacore, flow cytometry or any other quantitative or qualitative antibody-binding assay available in the art. In accordance with certain embodiments of the present invention, two antigen-binding proteins bind to the same (or overlapping) epitope if, e.g., a 1-, 5-, 10-, 20- or 100-fold excess of one antigen-binding protein inhibits binding of the other by at least 50% but preferably 75%, 90% or even 99% as measured in a competitive binding assay (see, e.g., Junghans et al., Cancer Res. 1990:50:1495-1502). Alternatively, two antigen-binding proteins are deemed to bind to the same epitope if essentially all amino acid mutations in the antigen that reduce or eliminate binding of one antigen-binding protein reduce or eliminate binding of the other. Two antigen-binding proteins are deemed to have "overlapping epitopes" if only a subset of the amino acid mutations that reduce or eliminate binding of one antigen-binding protein reduce or eliminate binding of the other.

To determine if an antibody or antigen-binding domain thereof competes for binding with a reference antigen-binding molecule, the above-described binding methodology is performed in two orientations: In a first orientation, the reference antigen-binding molecule is allowed to bind to a STEAP2 protein (or CD3 protein) under saturating conditions followed by assessment of binding of the test antibody to the STEAP2 (or CD3) molecule. In a second orientation, the test antibody is allowed to bind to a STEAP2 (or CD3) molecule under saturating conditions followed by assessment of binding of the reference antigen-binding molecule to the STEAP2 (or CD3) molecule. If, in both orientations, only the first (saturating) antigen-binding molecule is capable of binding to the STEAP2 (or CD3) molecule, then it is concluded that the test antibody and the reference antigen-binding molecule compete for binding to STEAP2 (or CD3). As will be appreciated by a person of ordinary skill in the art, an antibody that competes for binding with a reference antigen-binding molecule may not necessarily bind to the same epitope as the reference antibody, but may sterically block binding of the reference antibody by binding an overlapping or adjacent epitope.

Preparation of Antigen-Binding Domains and Construction of Bispecific Molecules

Antigen-binding domains specific for particular antigens can be prepared by any antibody generating technology known in the art. Once obtained, two different antigen-binding domains, specific for two different antigens (e.g., CD3 and STEAP2), can be appropriately arranged relative to one another to produce a bispecific antigen-binding molecule of the present invention using routine methods. (A discussion of exemplary bispecific antibody formats that can be used to construct the bispecific antigen-binding molecules of the present invention is provided elsewhere herein). In certain embodiments, one or more of the individual components (e.g., heavy and light chains) of the multispecific antigen-binding molecules of the invention are derived from chimeric, humanized or fully human antibodies. Methods for making such antibodies are well known in the art. For example, one or more of the heavy and/or light chains of the bispecific antigen-binding molecules of the present invention can be prepared using VELOCIMMUNE™ technology. Using VELOCIMMUNE™ technology (or any other human antibody generating technology), high affinity chimeric antibodies to a particular antigen (e.g., CD3 or STEAP2) are initially isolated having a human variable region and a mouse constant region. The antibodies are characterized and selected for desirable characteristics, including affinity, selectivity, epitope, etc. The mouse constant regions are replaced with a desired human constant region to generate fully human heavy and/or light chains that can be incorporated into the bispecific antigen-binding molecules of the present invention.

Genetically engineered animals may be used to make human bispecific antigen-binding molecules. For example, a genetically modified mouse can be used which is incapable of rearranging and expressing an endogenous mouse immunoglobulin light chain variable sequence, wherein the mouse expresses only one or two human light chain variable domains encoded by human immunoglobulin sequences operably linked to the mouse kappa constant gene at the endogenous mouse kappa locus. Such genetically modified mice can be used to produce fully human bispecific antigen-binding molecules comprising two different heavy chains that associate with an identical light chain that comprises a variable domain derived from one of two different human light chain variable region gene segments. (See, e.g., US 2011/0195454). Fully human refers to an antibody, or antigen-binding fragment or immunoglobulin domain thereof, comprising an amino acid sequence encoded by a DNA derived from a human sequence over the entire length of each polypeptide of the antibody or antigen-binding fragment or immunoglobulin domain thereof. In some instances, the fully human sequence is derived from a protein endogenous to a human. In other instances, the fully human protein or protein sequence comprises a chimeric sequence wherein each component sequence is derived from human sequence. While not being bound by any one theory, chimeric proteins or chimeric sequences are generally designed to minimize the creation of immunogenic epitopes in the junctions of component sequences, e.g. compared to any wild-type human immunoglobulin regions or domains.

Bioequivalents

The present invention encompasses antigen-binding molecules having amino acid sequences that vary from those of the exemplary molecules disclosed herein but that retain the ability to bind CD3 and/or STEAP2. Such variant molecules may comprise one or more additions, deletions, or substitutions of amino acids when compared to parent sequence, but exhibit biological activity that is essentially equivalent to that of the described bispecific antigen-binding molecules.

The present invention includes antigen-binding molecules that are bioequivalent to any of the exemplary antigen-binding molecules set forth herein. Two antigen-binding proteins, or antibodies, are considered bioequivalent if, for example, they are pharmaceutical equivalents or pharmaceutical alternatives whose rate and extent of absorption do not show a significant difference when administered at the same molar dose under similar experimental conditions, either single does or multiple dose. Some antigen-binding proteins will be considered equivalents or pharmaceutical alternatives if they are equivalent in the extent of their absorption but not in their rate of absorption and yet may be considered bioequivalent because such differences in the rate of absorption are intentional and are reflected in the labeling, are not essential to the attainment of effective body drug concentrations on, e.g., chronic use, and are considered medically insignificant for the particular drug product studied.

In one embodiment, two antigen-binding proteins are bioequivalent if there are no clinically meaningful differences in their safety, purity, and potency.

In one embodiment, two antigen-binding proteins are bioequivalent if a patient can be switched one or more times between the reference product and the biological product without an expected increase in the risk of adverse effects, including a clinically significant change in immunogenicity, or diminished effectiveness, as compared to continued therapy without such switching.

In one embodiment, two antigen-binding proteins are bioequivalent if they both act by a common mechanism or mechanisms of action for the condition or conditions of use, to the extent that such mechanisms are known.

Bioequivalence may be demonstrated by in vivo and in vitro methods. Bioequivalence measures include, e.g., (a) an in vivo test in humans or other mammals, in which the concentration of the antibody or its metabolites is measured in blood, plasma, serum, or other biological fluid as a function of time; (b) an in vitro test that has been correlated with and is reasonably predictive of human in vivo bioavailability data; (c) an in vivo test in humans or other mammals in which the appropriate acute pharmacological effect of the antibody (or its target) is measured as a function of time; and (d) in a well-controlled clinical trial that establishes safety, efficacy, or bioavailability or bioequivalence of an antigen-binding protein.

Bioequivalent variants of the exemplary bispecific antigen-binding molecules set forth herein may be constructed by, for example, making various substitutions of residues or sequences or deleting terminal or internal residues or sequences not needed for biological activity. For example, cysteine residues not essential for biological activity can be deleted or replaced with other amino acids to prevent formation of unnecessary or incorrect intramolecular disulfide bridges upon renaturation. In other contexts, bioequivalent antigen-binding proteins may include variants of the exemplary bispecific antigen-binding molecules set forth herein comprising amino acid changes which modify the glycosylation characteristics of the molecules, e.g., mutations which eliminate or remove glycosylation.

Species Selectivity and Species Cross-Reactivity

According to certain embodiments of the invention, antigen-binding molecules are provided which bind to human CD3 but not to CD3 from other species. Also provided are antigen-binding molecules which bind to human STEAP2 but not to STEAP2 from other species. The present invention also includes antigen-binding molecules that bind to human CD3 and to CD3 from one or more non-human species; and/or antigen-binding molecules that bind to human STEAP2 and to STEAP2 from one or more non-human species.

According to certain exemplary embodiments of the invention, antigen-binding molecules are provided which bind to human CD3 and/or human STEAP2 and may bind or not bind, as the case may be, to one or more of mouse, rat, guinea pig, hamster, gerbil, pig, cat, dog, rabbit, goat, sheep, cow, horse, camel, cynomolgus, marmoset, rhesus or chimpanzee CD3 and/or STEAP2. For example, in a particular exemplary embodiment of the present invention bispecific antigen-binding molecules are provided comprising a first antigen-binding domain that binds human CD3 and cynomolgus CD3, and a second antigen-binding domain that specifically binds human STEAP2.

Antibody-Drug Conjugates (ADCs)

The present invention provides antibody-drug conjugates (ADCs) comprising an anti-STEAP2 antibody or antigen-binding fragment thereof conjugated to a therapeutic moiety such as a cytotoxic agent, a chemotherapeutic drug, immunosuppressant or a radioisotope. In general terms, the ADCs comprise: A-[L-P]$_y$, in which A is an antigen-binding molecule, e.g. an anti-STEAP2 antibody, or a fragment thereof (e.g., a fragment comprising at least a HCDR3 selected from any of the HCDR3 amino acid sequences listed in Table 1), L is a linker, P is the payload or therapeutic moiety (e.g., cytotoxic agent), and y is an integer from 1 to 30. In various embodiments, the ADC comprises an anti-STEAP2 antibody or antigen-binding fragment thereof that comprises the CDRs of a HCVR and a LCVR having the amino acid sequences of the SEQ ID NOs (e.g., SEQ ID NOs: 2 and 10) set forth in Table 1, or specific HCVR/LCVR pairs (e.g., SEQ ID NOs: 2/10). In some cases, the anti-STEAP2 antibody or fragment comprises CDRs with the amino acid sequences of the SEQ ID NOs (e.g., SEQ ID NOs: 4-6-8-12-14-16) set forth in Table 1. In some cases, the anti-STEAP2 antibody or fragment comprises a HCVR and a LCVR having the amino acid sequences of the SEQ ID NOs (e.g., SEQ ID NOs: 2 and 10) set forth in Table 1, or specific amino acid sequence pairs (e.g., SEQ ID NOs: 2/10).

Cytotoxic agents include any agent that is detrimental to the growth, viability or propagation of cells. The antigen-binding molecules or antibodies of the invention deliver these cytotoxic agents, referred to herein as "payloads", to the target cells. Examples of suitable cytotoxic agents and chemotherapeutic agents for forming ADCs are known in the art.

Examples of suitable cytotoxic agents and chemotherapeutic agents that can be conjugated to anti-STEAP2 antibodies in accordance with this aspect of the invention include, e.g., 1-(2chloroethyl)-1,2-dimethanesulfonyl hydrazide, 1,8-dihydroxy-bicyclo[7.3.1]trideca-4,9-diene-2,6-diyne-13-one, 1-dehydrotestosterone, 5-fluorouracil, 6-mercaptopurine, 6-thioguanine, 9-amino camptothecin, actinomycin D, amanitins, aminopterin, anguidine, anthracycline, anthramycin (AMC), auristatins (monomethyl auristatin E or monomethyl auristatin F), bleomycin, busulfan, butyric acid, calicheamicins, camptothecin, carminomycins, carmustine, cemadotins, cisplatin, colchicin, combretastatins, cyclophosphamide, cytarabine, cytochalasin B, dactinomycin, daunorubicin, decarbazine, diacetoxypentyl-doxorubicin, dibromomannitol, dihydroxy anthracin dione, disorazoles, dolastatin, doxorubicin, duocarmycin, echinomycins, eleutherobins, emetine, epothilones, esperamicin, estramustines, ethidium bromide, etoposide, fluorouracils, geldanamycins, gramicidin D, glucocorticoids, irinotecans, leptomycins, leurosines, lidocaine, lomustine (CCNU), maytansinoids, mechlorethamine, melphalan, mercatopurines, methopterins, methotrexate, mithramycin, mitomycin, mitoxantrone, N8-acetyl spermidine, podophyllotoxins, procaine, propranolol, pteridines, puromycin, rhizoxins, streptozotocin, tallysomycins, taxol, tenoposide, tetracaine, thioepa chlorambucil, tomaymycins, topotecans, tubulysin, vinblastine, vincristine, vindesine, vinorelbines, and derivatives of any of the foregoing.

According to certain embodiments, the cytotoxic agent that is conjugated to an anti-STEAP2 antibody is an auristatin such as monomethyl auristatin E (MMAE) or monomethyl auristatin F (MMAF), a tubulysin such as TUB-OH or TUB-OMOM, a tomaymycin derivative, a dolastatin derivative, or a maytansinoid such as DM1 or DM4. In some embodiments, the cytotoxic agent is a maytansinoid having the structure of Formula (I), including stereoisomers of the compounds of Formula (I):

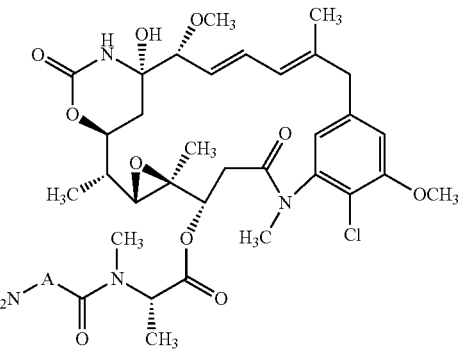

(Formula I)

wherein A is arylene or heteroarylene.

In some embodiments, A is a divalent radical of benzene, of pyridine, of naphthalene, or of quinolone, which are optionally substituted.

In some embodiments, A is arylene.
In some embodiments, A is:

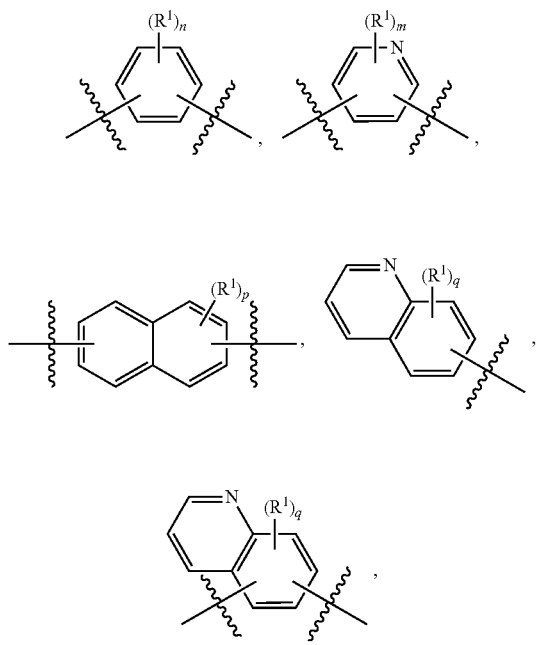

wherein:

R¹ is, independently at each occurrence, alkyl, alkenyl, alkynyl, aryl, alkaryl, aralkyl, halo, heteroaryl, heterocycloalkyl, hydroxyl, cyano, nitro,

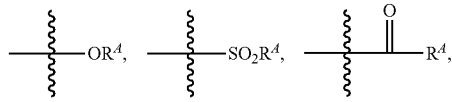

or azido, wherein $R^A$ is alkyl or heteroalkyl;
n is an integer from 0 to 4;
m is and integer from 0 to 3;
p is an integer from 0 to 6; and
q is an integer from 0 to 5.

In some embodiments, the compound of Formula I is selected from the group consisting of:

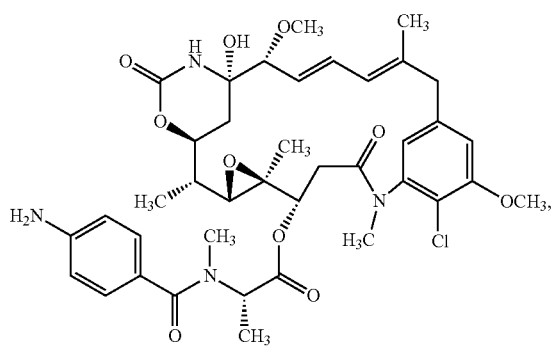

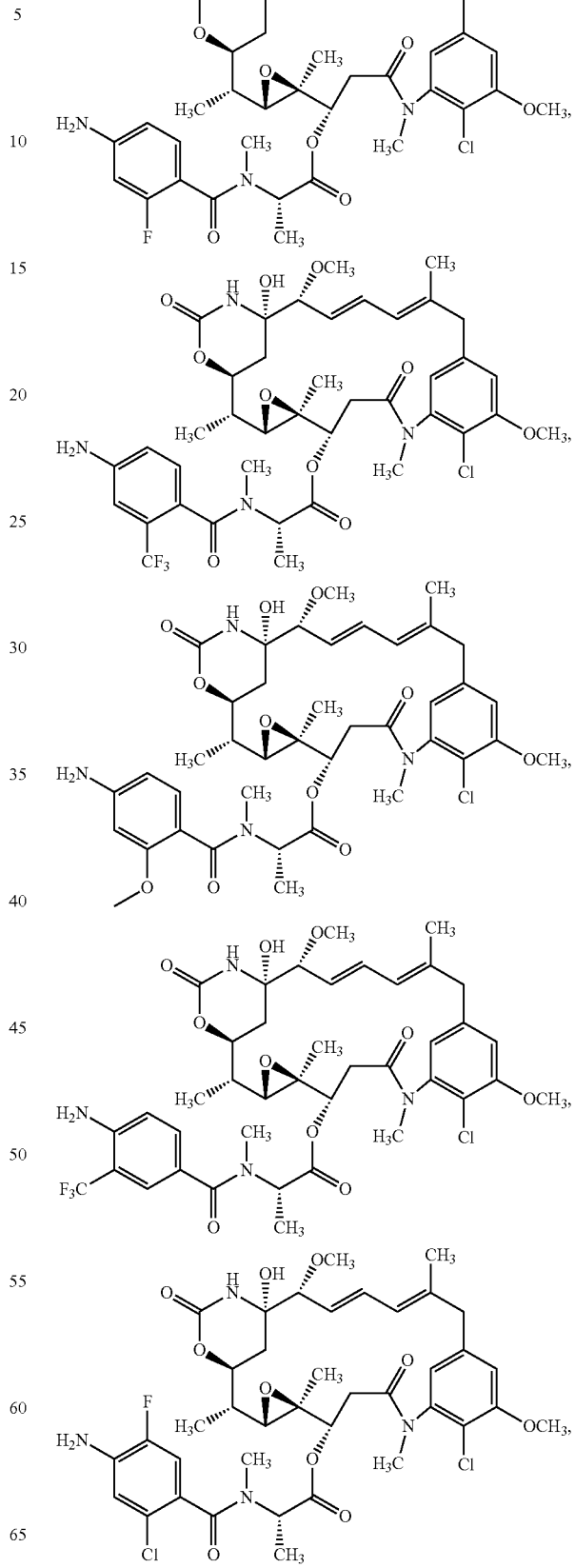

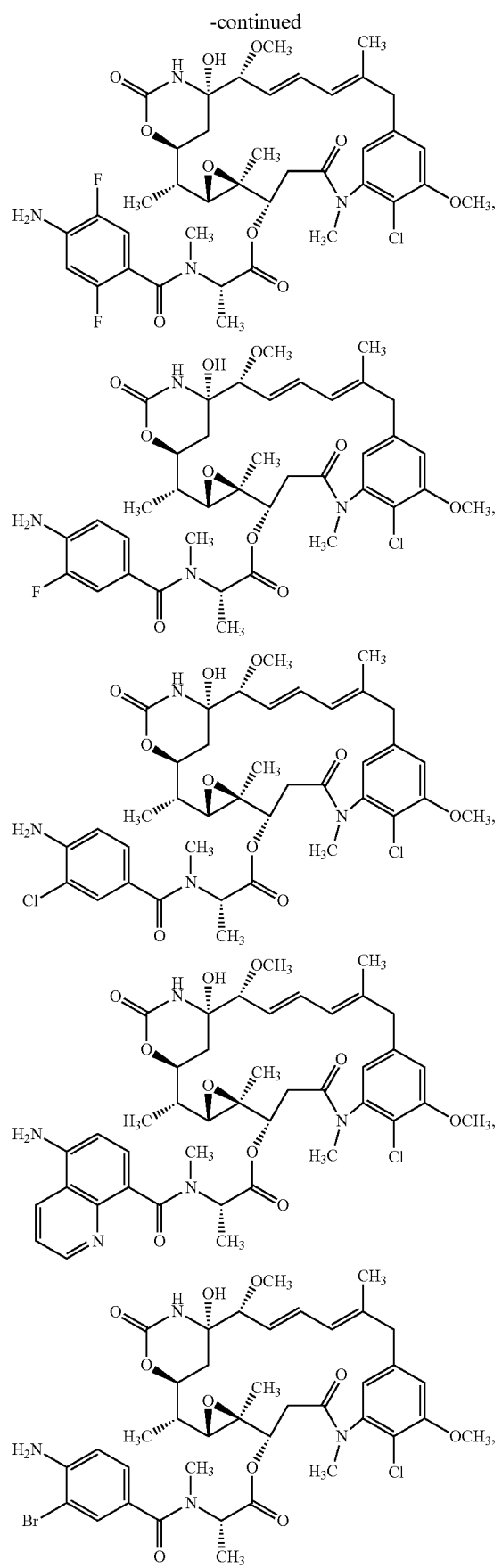
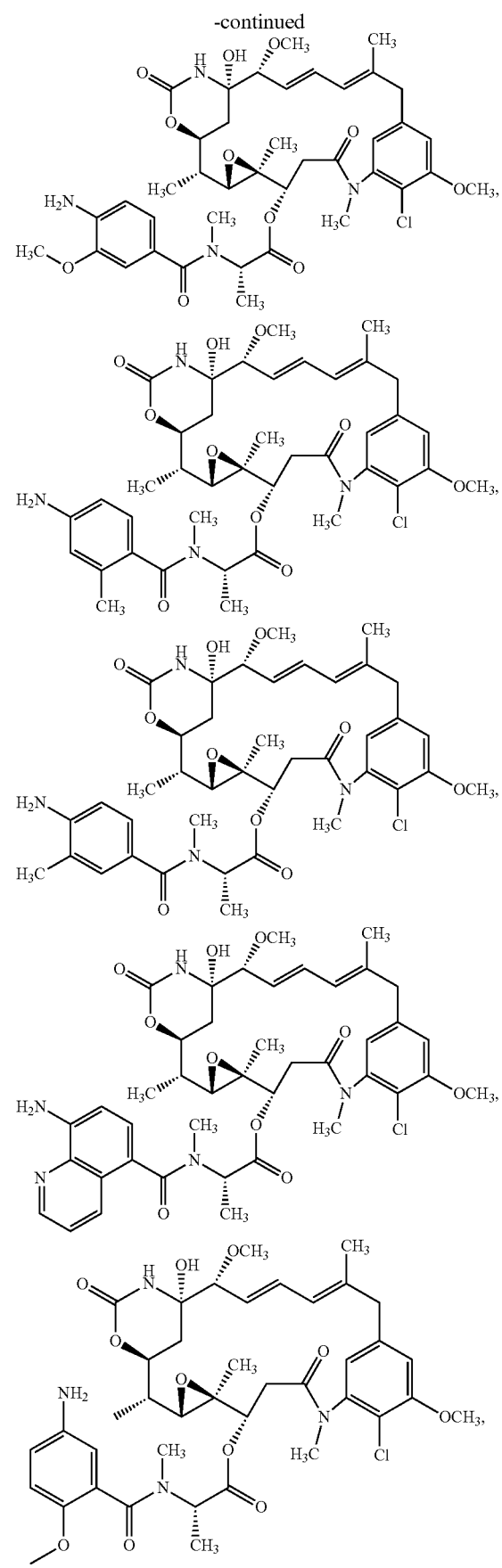

-continued
51
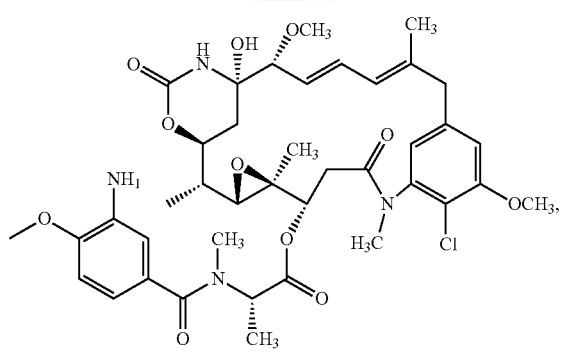
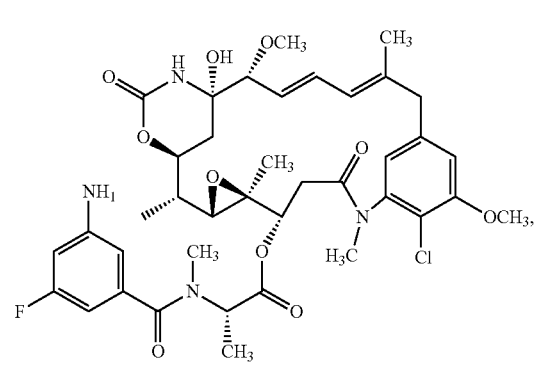
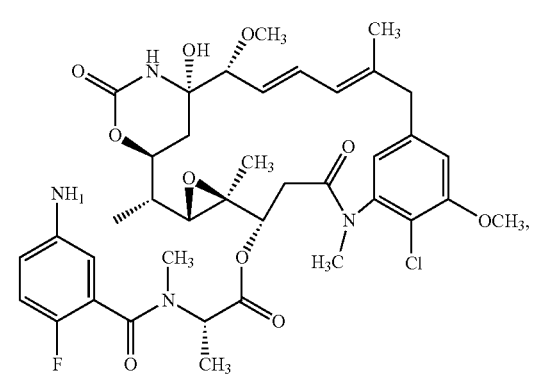
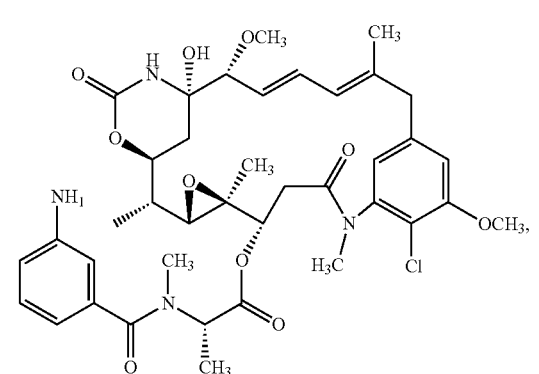
52
-continued
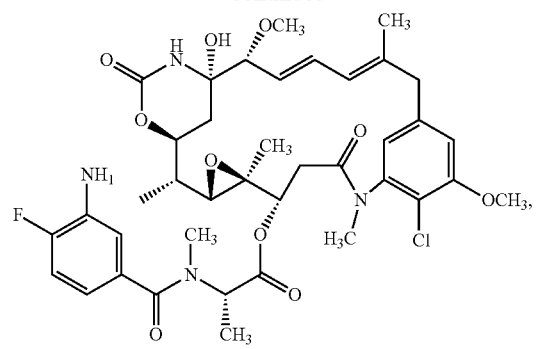
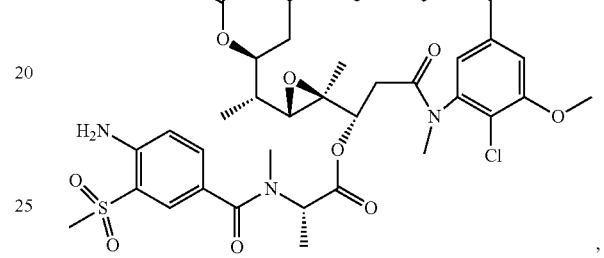
,
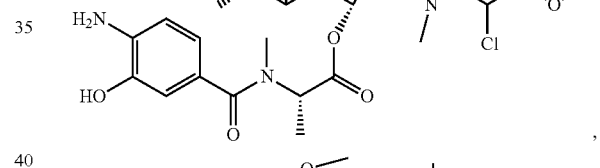
,
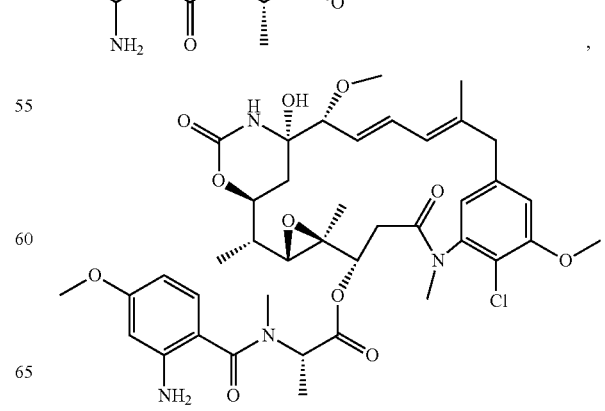

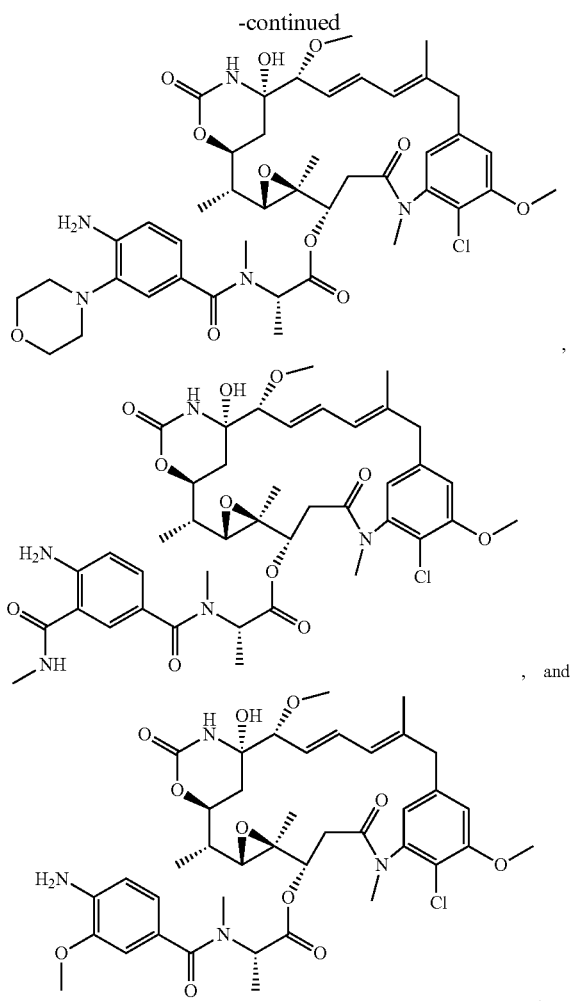
, and

In one embodiment, the compound of Formula (I) is:

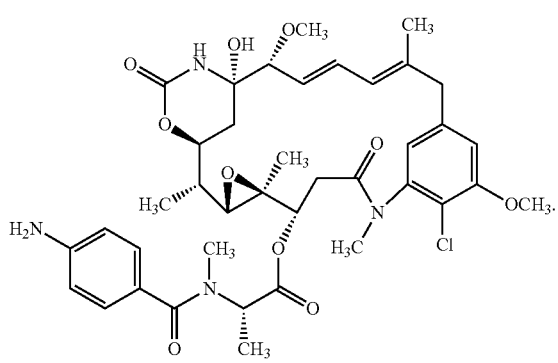 [SMILES: COc1cc2cc(c1Cl)N(C)C(=O)C[C@H](OC(=O)[C@H](C)N(C)C(=O)c1ccc(N)cc1)[C@]1(C)O[C@H]1[C@H](C)[C@@H]1C[C@@](O)(NC(=O)O1)[C@H](OC)/C=C/C=C(\C)C2]

In some embodiments, the maytansinoid of Formula (I) is conjugated to an anti-STEAP2 antibody or antigen-binding fragment thereof via a linker, as shown in Formula (IA), below:

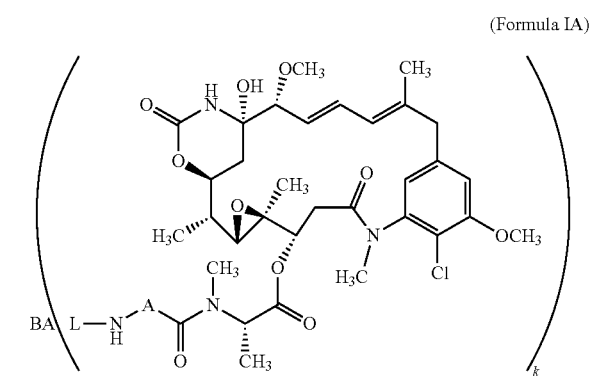

(Formula IA)

wherein:
A is arylene or heteroarylene, as discussed above in connection with Formula (I);
L is a linker;
BA is an anti-STEAP2 antibody or antigen-binding fragment thereof; and
k is an integer from 1 to 30.

In various embodiments, L is:

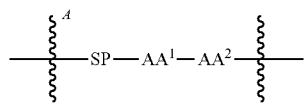

wherein:
SP is a spacer;

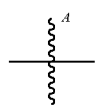

is one or more bonds to the anti-STEAP2 antibody or fragment thereof;
$AA^1$ is an amino acid; and
$AA^2$ is an amino acid.

In some embodiments, $AA^1$-$AA^2$ is: valine-citrulline, citrulline-valine, lysine-phenylalanine, phenylalanine-lysine, valine-asparagine, asparagine-valine, threonine-asparagine, asparagine-threonine, serine-asparagine, asparagine-serine, phenylalanine-asparagine, asparagine-phenylalanine, leucine-asparagine, asparagine-leucine, isoleucine-asparagine, asparagine-isoleucine, glycine-asparagine, asparagine-glycine, glutamic acid-asparagine, asparagine-glutamic acid, citrulline-asparagine, asparagine-citrulline, alanine-asparagine, or asparagine-alanine.

In some embodiments, SP is:

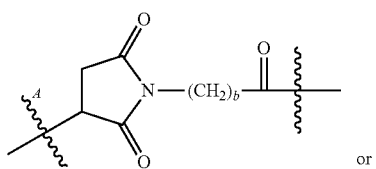

or

-continued

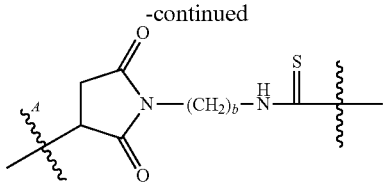

wherein:

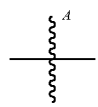

is a bond to the anti-STEAP2 antibody or fragment thereof; and
b is an integer from 2 to 8.

In other embodiments, L is:

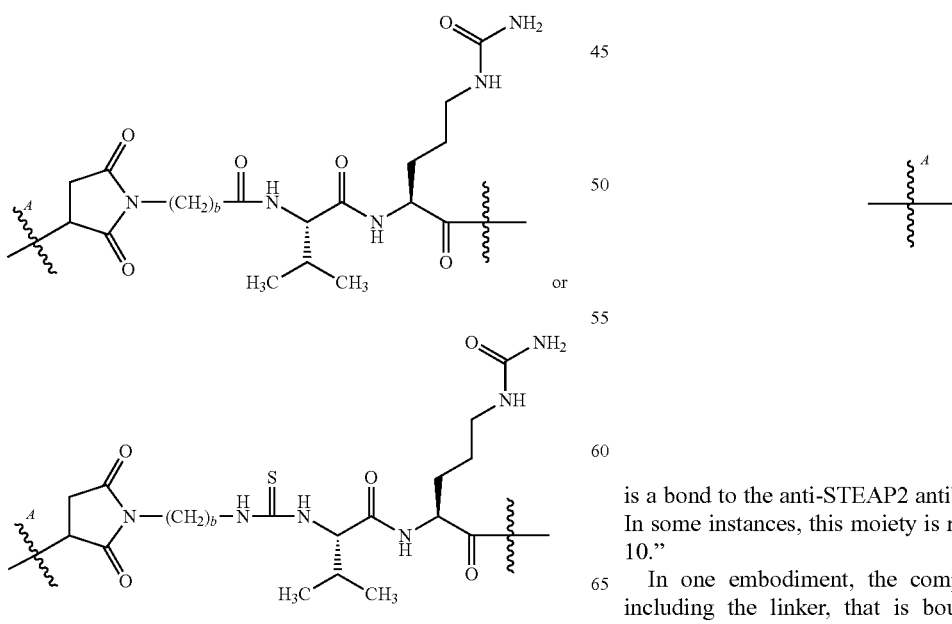

wherein:

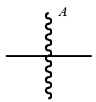

is a bond to the anti-STEAP2 antibody or fragment thereof; and
b is an integer from 2 to 8.

In one embodiment, the compound of Formula (IA), including the linker, that is bound to the anti-STEAP2 antibody or antigen-binding fragment thereof is:

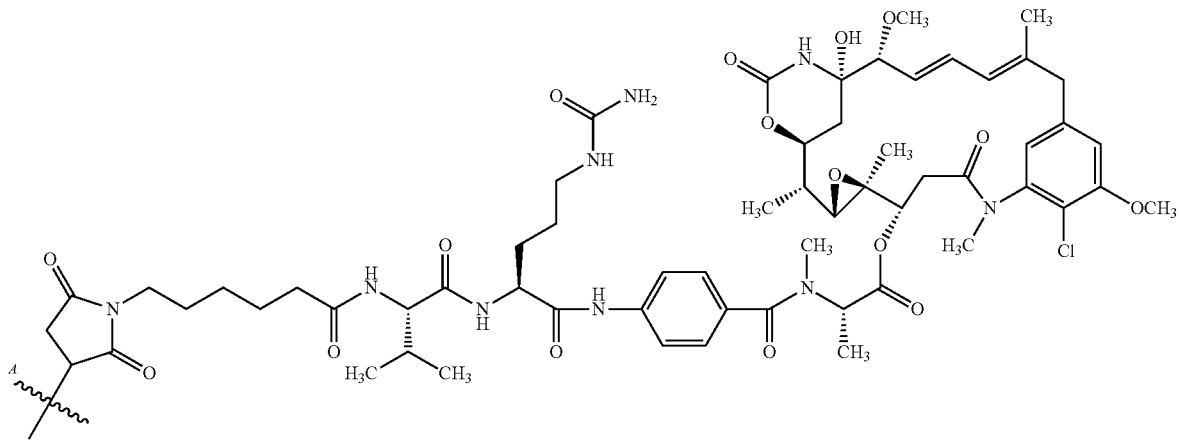

wherein

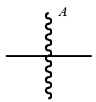

is a bond to the anti-STEAP2 antibody or fragment thereof. In some instances, this moiety is referred to as "Compound 10."

In one embodiment, the compound of Formula (IA), including the linker, that is bound to the anti-STEAP2 antibody or antigen-binding fragment thereof is:

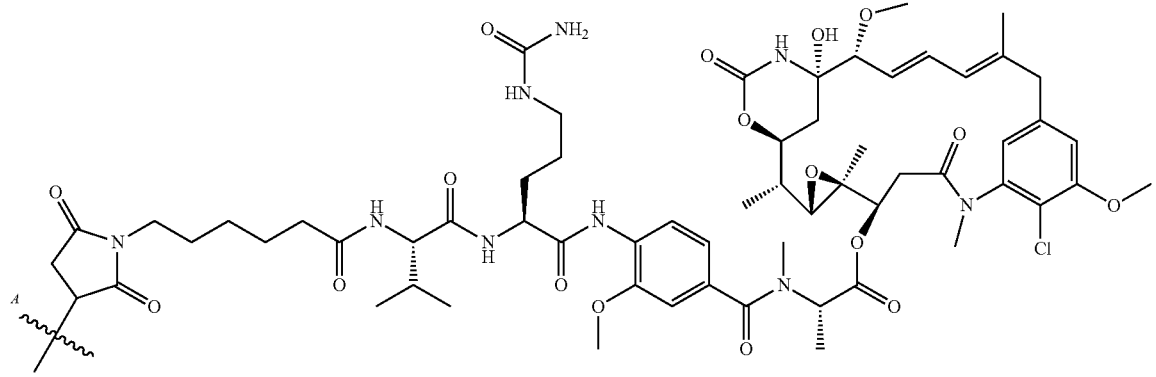

wherein

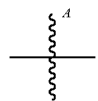

is a bond to the anti-STEAP2 antibody or fragment thereof. In some instances, this moiety is referred to as "Compound 60."

In some embodiments, the cytotoxic agent is a maytansinoid having the structure of Formula (II), including stereoisomers of the compounds of Formula (II):

(Formula II)

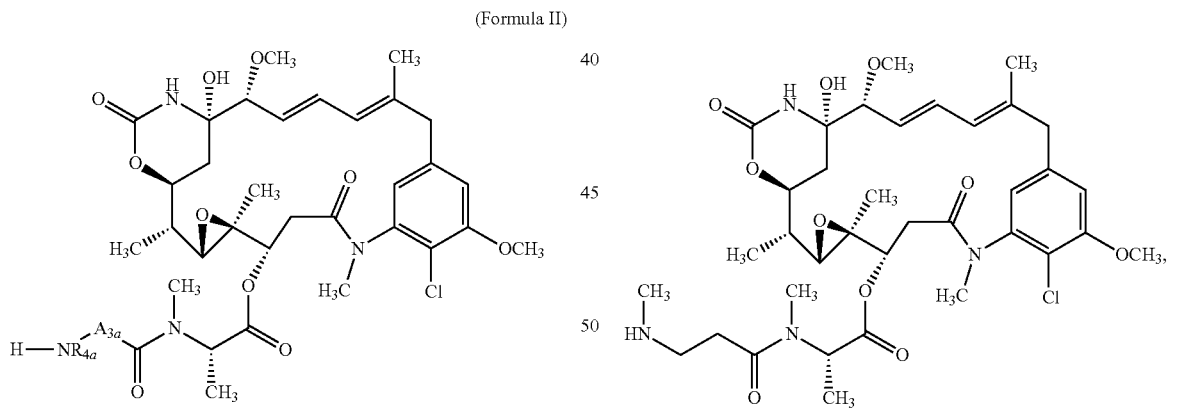

wherein:
$A_{3a}$ is an amino acid, a peptide having 2-20 amino acids, an alkyl, an alkynyl, an alkenyl, a cycloalkyl, an aryl, a heteroaryl, a heterocyclyl, —CR$_5$R$_6$—, —O—, —C(=O)—, —O—C(=O)—, —C(=O)—O—, —O—C(=O)—O—, —C(=O)—(CH$_x$)$_{p1}$—, —C(=O)—O—(CH$_x$)$_{p1}$—, —(CH$_x$)$_{p1}$—C(=O)—, —(CH$_x$)$_{p1}$—C(=O)—O—, —(O—(CH$_2$)$_{p2}$—)$_{p3}$—, —((CH$_2$)$_{p2}$—O—)$_{p3}$—, —C(=S)—, —C(=S)—S—, —C(=S)—NH—, —S—C(=S)—, —S—C(=S)—S—, —S—, —SO—, —SO$_2$—, —NR$_4$—, —N(R$_4$)—C(=O)—N(R$_8$)—, —N(R$_4$)—C(=O)O—, —N(R$_4$)—C(=O)—, —C(=O)—N(R$_4$)—, —C(=O)—N(R$_4$)—C(=O)—, or —O—C(=O)—NR$_4$—, wherein alkyl, alkynyl, alkenyl, cycloalkyl, aryl, heteroaryl, and heterocyclyl are optionally substituted; and p1, p2 and p3 are each independently 0, or an integer from 1 to 100;

x is 0, 1 or 2;

R$_4$, R$_5$, R$_6$ and R$_8$ are each independently H, or a substituted or unsubstituted: alkyl, alkenyl, alkynyl, aryl, heteroaryl, or heterocyclyl; and R$_{4a}$ is a substituted or unsubstituted: alkyl, alkenyl, alkynyl, aryl, heteroaryl, or heterocyclyl.

In some embodiments, the compound of Formula (II) is selected from the group consisting of:

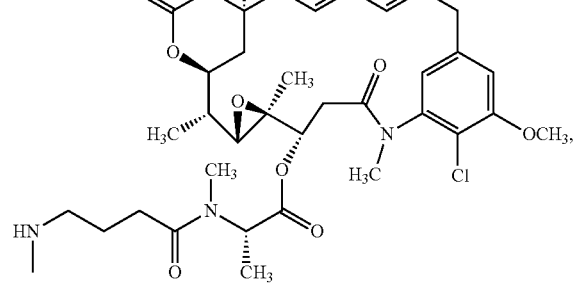

59
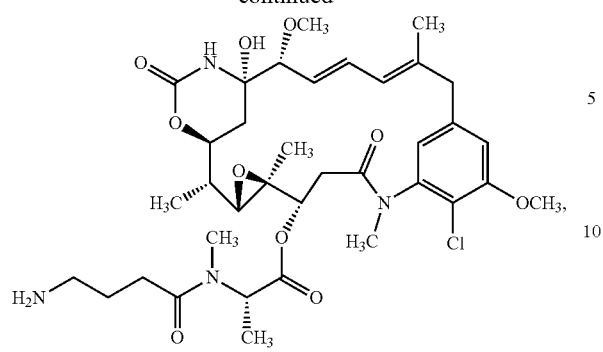
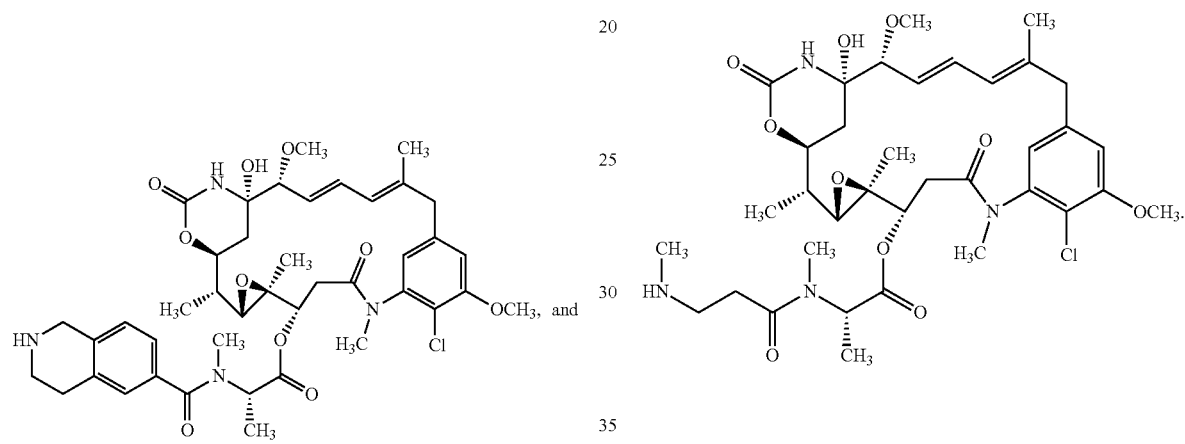
60
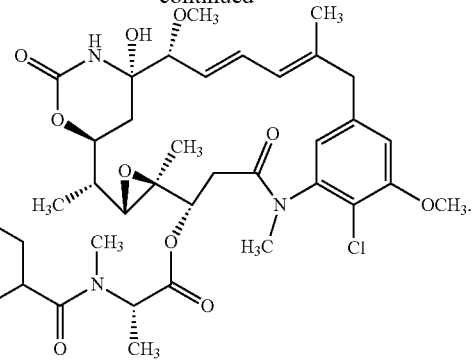
In one embodiment, the compound of Formula (II) is:
In some embodiments, the maytansinoid of Formula (II) is conjugated to an anti-STEAP2 antibody or antigen-binding fragment thereof via a linker, as shown in Formula (IIA), below:
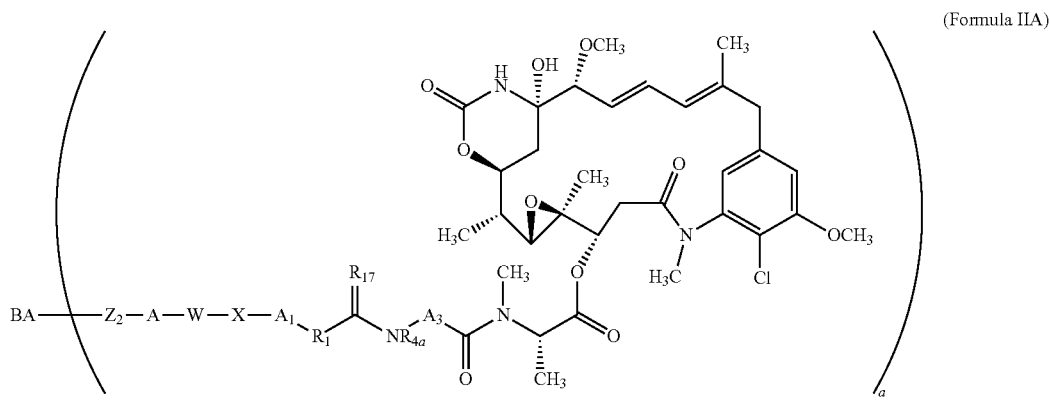
(Formula IIA)

wherein:

BA is an anti-STEAP2 antibody or antigen-binding fragment thereof;

a is an integer from 1 to 30;

$Z_2$ is represented by the following structural formula: $-Z_{2A}-Z_{2B}-Z_{2C}-Z_{2D}$, wherein $Z_{2A}$, $Z_{2B}$, $Z_2c$ and $Z_{2D}$ are each independently absent, an amino acid, a peptide having 2-20 amino acids, an alkyl, an alkynyl, an alkenyl, a cycloalkyl, an aryl, a heteroaryl, a heterocyclyl, $-CR_5R_6-$, $-O-$, $-C(=O)-$, $-O-C(=O)-$, $-C(=O)-O-$, $-O-C(=O)-O-$, $-C(=O)-(CH_x)_{p1}$, $-C(=O)-O-(CH_x)_{p1}$, $-(CH_x)_{p1}-C(=O)-$, $-(CH_x)_{p1}-C(=O)-O-$, $-(O-(CH_2)_{p2}-)_{p3}-$, $-((CH_2)_{p2}-O-)_{p3}-$, $-C(=S)-$, $-C(=S)_{p3}-S-$, $-C(=S)-NH-$, $-S-C(=S)-$, $-S-C(=S)-S-$, $-S-$, $-SO-$, $-SO_2-$, $-NR_4-$, $-N(R_4)-C(=O)-N(R_8)-$, $-N(R_4)-C(=O)O-$, $-N(R_4)-C(=O)-$, $-C(=O)-N(R_4)-$, $-C(=O)-N(R_4)-C(=O)-$, $-O-C(=O)-N(R_4)$, $-O-C(=S)-N(R_4)-$, $-C(=S)-N(R_4)-$, $-N=C=S$, $-N=C=O$,

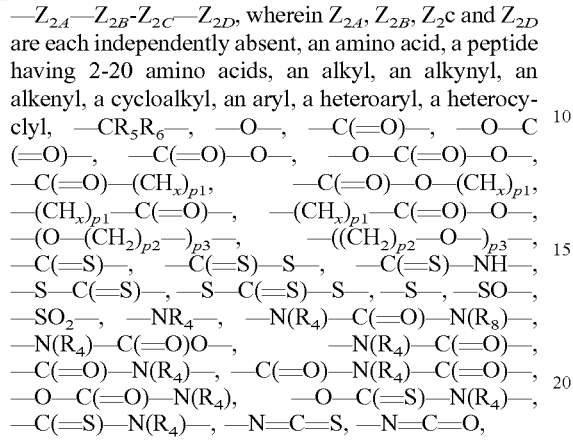

A is a natural or non-natural amino acid, or a peptide comprising 2-20 amino acids;

$C(=O)-$, or $-O-C(=O)-NR_4-$, wherein alkyl, alkynyl, alkenyl, cycloalkyl, aryl, heteroaryl, and heterocyclyl are optionally substituted;

$R_{17}$ is selected from the group consisting of O, S, $NR_{18}$, and $CR_5R_6$;

$R_{18}$ is selected from the group consisting of H, alkyl, alkynyl, alkenyl, cycloalkyl, aryl, heteroaryl, heterocyclyl, and acyl, wherein alkyl, alkynyl, alkenyl, cycloalkyl, aryl, heteroaryl, heterocyclyl, and acyl are optionally substituted;

$R_4$, $R_5$, $R_6$ and $R_8$ are each independently H, or a substituted or unsubstituted: alkyl, alkenyl, alkynyl, aryl, heteroaryl, or heterocyclyl;

$R_{4a}$ is a substituted or unsubstituted: alkyl, alkenyl, alkynyl, aryl, heteroaryl, or heterocyclyl;

p1, p2 and p3 are each independently 0, or an integer from 1 to 100; and x is 0, 1 or 2.

In some embodiments of Formula (IIA), A is a peptide selected from the group consisting of valine-citrulline, citrulline-valine, lysine-phenylalanine, phenylalanine-lysine, valine-asparagine, asparagine-valine, threonine-asparagine, asparagine-threonine, serine-asparagine, asparagine-serine, phenylalanine-asparagine, asparagine-phenylalanine, leucine-asparagine, asparagine-leucine, isoleucine-asparagine, asparagine-isoleucine, glycine-asparagine, asparagine-glycine, glutamic acid-asparagine, asparagine-glutamic acid, citrulline-asparagine, asparagine-citrulline, alanine-asparagine, and asparagine-alanine.

In one embodiment, the compound of Formula (IIA) that is bound to the anti-STEAP2 antibody or antigen-binding fragment thereof is:

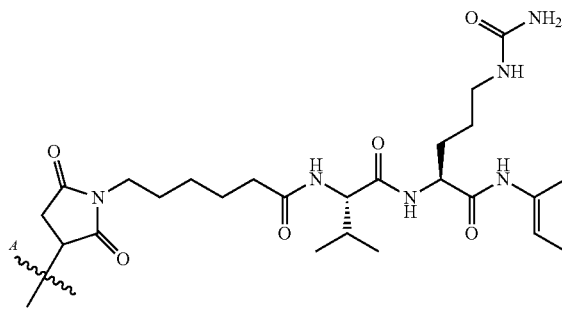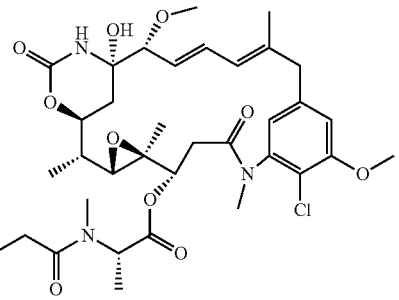

W is $-O-$, $-S-$, $-CR_5R_6-$, or $-NR_4-$;

X is aryl, heteroaryl, cycloalkyl, or heterocyclyl, wherein aryl, heteroaryl, cycloalkyl, and heterocyclyl are optionally substituted;

wherein $A_1$, $A_3$, and $R_1$ are each independently an amino acid, a peptide having 2-20 amino acids, an alkyl, an alkynyl, an alkenyl, a cycloalkyl, an aryl, a heteroaryl, a heterocyclyl, $-CR_5R_6-$, $-O-$, $-C(=O)-$, $-O-C(=O)-$, $-C(=O)-O-$, $-O-C(=O)-O-$, $-C(=O)-(CH_x)_{p1}-$, $-C(=O)-O-(CH_x)_{p1}-$, $-(CH_x)_{p1}-C(=O)-$, $-(CH_x)_{p1}-C(=O)-O-$, $-(O-(CH_2)_{p2}-)_{p3}-$, $-((CH_2)_{p2}-O-)_{p3}-$, $-C(=S)-$, $-C(=S)-S-$, $-S-C(=S)-$, $-C(=S)-NH-$, $-S-C(=S)-S-$, $-S-$, $-SO-$, $-SO_2-$, $-NR_4-$, $-N(R_4)-C(=O)-N(R_8)-$, $-N(R_4)-C(=O)O-$, $-N(R_4)-C(=O)-$, $-C(=O)-N(R_4)-$, $-C(=O)-N(R_4)-$ wherein

is a bond to the anti-STEAP2 antibody or fragment thereof. In some instances, this moiety is referred to as "Compound 7."

In some embodiments, the cytotoxic agent that is conjugated to an anti-STEAP2 antibody or fragment thereof is a pure, or substantially pure, diastereomer of DM1:

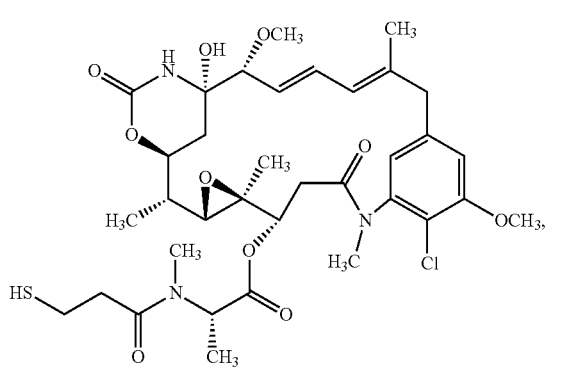 [SMILES: CNCCC(=O)N(C)[C@@H](C)C(=O)O[C@H]1CC(=O)N(C)c2cc(cc(OC)c2Cl)C/C(C)=C/C=C/[C@@H](OC)[C@@]2(O)C[C@H](OC(=O)N2)[C@@H](C)[C@@H]2O[C@@]12C]
(DM1)

and y is an integer 1 to 0.

In another embodiment, the ADC comprises a "A-[L-P]$_y$," structure in which A is an anti-STEAP2 antibody or antigen-binding fragment thereof, and [L-P] is:

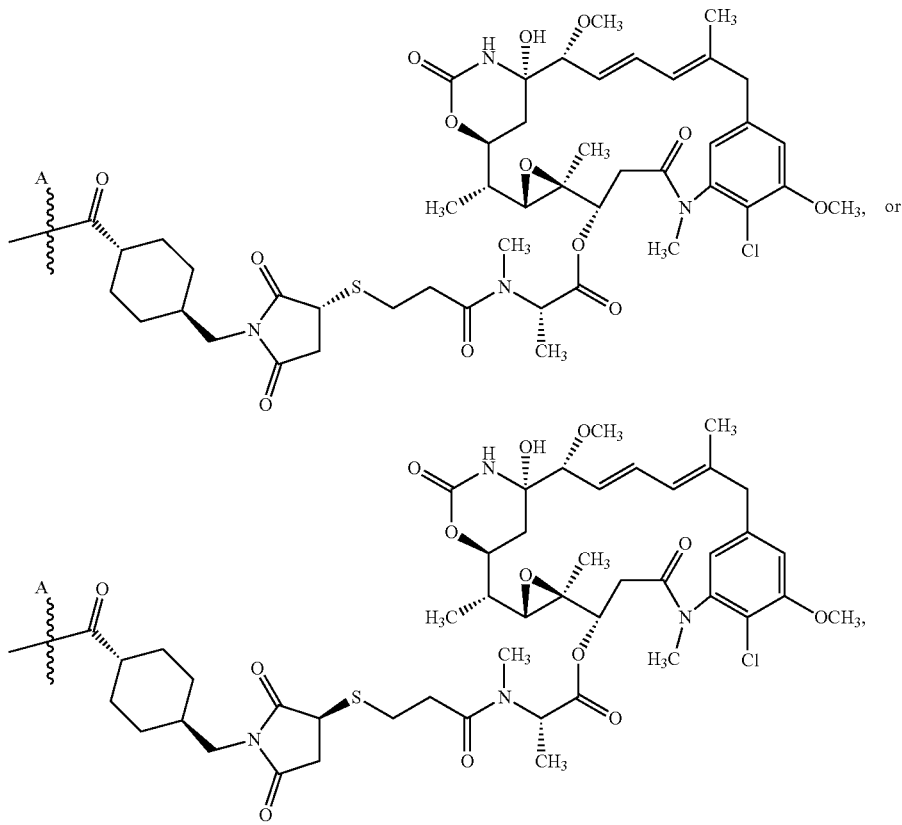

a mixture thereof, and wherein y is an integer 1 to 30, and is a bond to the anti-STEAP2 antibody or fragment thereof.

Other maytansinoid derivatives are discussed in WO 2014/145090, WO2016/160615, and WO 2015/031396, each of which is hereby incorporated by reference in its entirety.

In some embodiments, the cytotoxic agent that is conjugated to an anti-STEAP2 antibody or fragment thereof is MMAE or MMAF.

Other cytotoxic agents known in the art are contemplated within the scope of the present invention, including, e.g., protein toxins such as ricin, *C. difficile* toxin, pseudomonas exotoxin, diphtheria toxin, botulinum toxin, bryodin, saporin, pokeweed toxins (i.e., phytolaccatoxin and phytolaccigenin), and others such as those set forth in Sapra et al., Pharmacol. & Therapeutics, 2013, 138:452-469.

Cytotoxic agents ("payloads") can be tethered to an anti-STEAP2 antigen-binding molecule or antibody of the invention via a chemical linker that covalently binds the payload compound to the protein molecule (i.e. antibody). Exemplary embodiments of specific linkers are discussed above. More generally, and as used herein, the term "linker" refers to any divalent group or moiety that links, connects, or bonds a binding agent (e.g., an antibody or an antigen-binding fragment thereof) with a payload compound set forth herein. Generally, suitable binding agent linkers for the antibody conjugates described herein are those that are sufficiently stable to exploit the circulating half-life of the antibody and, at the same time, capable of releasing its payload after antigen-mediated internalization of the conjugate. Linkers can be cleavable or non-cleavable. Cleavable linkers are linkers that are cleaved by intracellular metabolism following internalization, e.g., cleavage via hydrolysis, reduction, or enzymatic reaction. Non-cleavable linkers are linkers that release an attached payload via lysosomal degradation of the antibody following internalization. Suitable linkers include, but are not limited to, acid-labile linkers, hydrolysis-labile linkers, enzymatically cleavable linkers, reduction labile linkers, self-immolative linkers, and non-cleavable linkers. Suitable linkers also include, but are not limited to, those that are or comprise peptides, glucuronides, succinimide-thioethers, polyethylene glycol (PEG) units, hydrazones, mal-caproyl units, dipeptide units, valine-citrulline units, and para-aminobenzyl (PAB) units. In some cases, the linker is capable of bonding to the antibody or antigen-binding fragment through a lysine residue or a cysteine residue (e.g., via cleavage of a disulfide group of the antibody or fragment, or via a cysteine residue engineered into the antibody or fragment). In some cases, the linker is capable of bonding to the antibody or fragment through a glutamine residue, including those derived via transglutaminase-mediated conjugation.

Exemplary linkers that can be used in the context of the present invention include linkers that comprise or consist of e.g., MC (6-maleimidocaproyl), MCC (maleimidomethyl cyclohexane-1-carboxylate), MP (maleimidopropanoyl), val-cit (valine-citrulline), val-ala (valine-alanine), ala-phe (alanine-phenylalanine), phe-lys (phenylalanine-lysine), dipeptide site in protease-cleavable linker, PAB (p-aminobenzyloxycarbonyl), SPP (N-Succinimidyl 4-(2-pyridylthio) pentanoate), SMCC (N-Succinimidyl 4-(N-maleimidomethyl)cyclohexane-1 carboxylate), SIAB (N-Succinimidyl (4-iodo-acetyl)aminobenzoate), and variants and combinations thereof. Additional examples of linkers that can be used in the context of the present invention are disclosed in, e.g., U.S. Pat. No. 7,754,681 and in Ducry, Bioconjugate Chem., 2010, 21:5-13, and the references cited therein, the contents of which are incorporated by reference herein in their entireties. In some cases, the linker is or contains a self-immolative spacer, such as those discussed in Jin, et al., *Bioorganic & Medicinal Chemistry*, 2012, 20:3465-3469, and Wu, et al., *Bioorganic & Medicinal Chemistry*, 2016, 24:2697-2706.

Payloads may be linked to the anti-STEAP2 antibody or antigen-binding fragment via an attachment at a particular amino acid within the antibody or antigen-binding molecule. Exemplary amino acid attachments that can be used in the context of this aspect of the invention include, e.g., lysine (see, e.g., U.S. Pat. No. 5,208,020; US 2010/0129314; Hollander et al., Bioconjugate Chem., 2008, 19:358-361; WO 2005/089808; U.S. Pat. No. 5,714,586; US 2013/0101546; and US 2012/0585592), cysteine (see, e.g., US 2007/0258987; WO 2013/055993; WO 2013/055990; WO 2013/053873; WO 2013/053872; WO 2011/130598; US 2013/0101546; and U.S. Pat. No. 7,750,116), selenocysteine (see, e.g., WO 2008/122039; and Hofer et al., Proc. Natl. Acad. Sci., USA, 2008, 105:12451-12456), formyl glycine (see, e.g., Carrico et al., Nat. Chem. Biol., 2007, 3:321-322; Agarwal et al., Proc. Natl. Acad. Sci., USA, 2013, 110:46-51, and Rabuka et al., Nat. Protocols, 2012, 10:1052-1067), non-natural amino acids (see, e.g., WO 2013/068874, and WO 2012/166559), and acidic amino acids (see, e.g., WO 2012/05982). Linkers can also be conjugated to an antigen-binding protein via attachment to carbohydrates (see, e.g., US 2008/0305497, and Ryan et al., Food & Agriculture Immunol., 2001, 13:127-130) and disulfide linkers (see, e.g., WO 2013/085925, WO 2010/010324, WO 2011/018611, and Shaunak et al., Nat. Chem. Biol., 2006, 2:312-313).

Drug-to-antibody ratio (DAR) is the average number of drugs conjugated to the antibody or antigen-binding fragment, which has an important effect on the efficacy, potency and pharmacokinetics of the ADC. In various embodiments, the DAR is from 1, 2, 3, 4, 5, 6, 7, or 8 drug molecules per antibody. In some embodiments, the DAR is from 1 to 4. In certain embodiments, the DAR is from 2 to 4. In some cases, the DAR is from 2 to 3. In certain cases, the DAR is from 3 to 4. In some embodiments, the DAR is from 1 to 10, 1 to 20 or 1 to 30 (i.e., from 1 to 30 drug molecules per antibody or antigen-binding fragment thereof).

Therapeutic Formulation and Administration

The present invention provides pharmaceutical compositions comprising the antigen-binding molecules of the present invention. The pharmaceutical compositions of the invention are formulated with suitable carriers, excipients, and other agents that provide improved transfer, delivery, tolerance, and the like. A multitude of appropriate formulations can be found in the formulary known to all pharmaceutical chemists: Remington's Pharmaceutical Sciences, Mack Publishing Company, Easton, Pa. These formulations include, for example, powders, pastes, ointments, jellies, waxes, oils, lipids, lipid (cationic or anionic) containing vesicles (such as LIPOFECTIN™, Life Technologies, Carlsbad, Calif.), DNA conjugates, anhydrous absorption pastes, oil-in-water and water-in-oil emulsions, emulsions carbowax (polyethylene glycols of various molecular weights), semi-solid gels, and semi-solid mixtures containing carbowax. See also Powell et al. "Compendium of excipients for parenteral formulations" PDA (1998) J Pharm Sci Technol 52:238-311.

The dose of antigen-binding molecule administered to a patient may vary depending upon the age and the size of the patient, target disease, conditions, route of administration, and the like. The preferred dose is typically calculated according to body weight or body surface area. When a bispecific antigen-binding molecule of the present invention is used for therapeutic purposes in an adult patient, it may be advantageous to intravenously administer the bispecific antigen-binding molecule of the present invention normally at a single dose of about 0.01 to about 20 mg/kg body weight, more preferably about 0.02 to about 7, about 0.03 to about 5, or about 0.05 to about 3 mg/kg body weight. Depending on the severity of the condition, the frequency and the duration of the treatment can be adjusted. Effective dosages and schedules for administering a bispecific antigen-binding molecule may be determined empirically; for example, patient progress can be monitored by periodic assessment, and the dose adjusted accordingly. Moreover, interspecies scaling of dosages can be performed using well-known methods in the art (e.g., Mordenti et al., 1991, *Pharmaceut. Res.* 8:1351).

Various delivery systems are known and can be used to administer the pharmaceutical composition of the invention, e.g., encapsulation in liposomes, microparticles, microcapsules, recombinant cells capable of expressing the mutant viruses, receptor mediated endocytosis (see, e.g., Wu et al., 1987, J. Biol. Chem. 262:4429-4432). Methods of introduction include, but are not limited to, intradermal, intramuscular, intraperitoneal, intravenous, subcutaneous, intranasal, epidural, and oral routes. The composition may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local.

A pharmaceutical composition of the present invention can be delivered subcutaneously or intravenously with a standard needle and syringe. In addition, with respect to subcutaneous delivery, a pen delivery device readily has applications in delivering a pharmaceutical composition of the present invention. Such a pen delivery device can be reusable or disposable. A reusable pen delivery device generally utilizes a replaceable cartridge that contains a pharmaceutical composition. Once all of the pharmaceutical composition within the cartridge has been administered and the cartridge is empty, the empty cartridge can readily be discarded and replaced with a new cartridge that contains the pharmaceutical composition. The pen delivery device can then be reused. In a disposable pen delivery device, there is no replaceable cartridge. Rather, the disposable pen delivery device comes prefilled with the pharmaceutical composition held in a reservoir within the device. Once the reservoir is emptied of the pharmaceutical composition, the entire device is discarded.

Numerous reusable pen and autoinjector delivery devices have applications in the subcutaneous delivery of a pharmaceutical composition of the present invention. Examples include, but are not limited to AUTOPEN™ (Owen Mumford, Inc., Woodstock, UK), DISETRONIC™ pen (Disetronic Medical Systems, Bergdorf, Switzerland), HUMALOG MIX 75/25™ pen, HUMALOG™ pen, HUMALIN 70/30™ pen (Eli Lilly and Co., Indianapolis, Ind.), NOVOPEN™ I, II and III (Novo Nordisk, Copenhagen, Denmark), NOVOPEN JUNIOR™ (Novo Nordisk, Copenhagen, Denmark), BD™ pen (Becton Dickinson, Franklin Lakes, N.J.), OPTIPEN™, OPTIPEN PRO™, OPTIPEN STARLET™, and OPTICLIK™ (sanofi-aventis, Frankfurt, Germany), to name only a few. Examples of disposable pen delivery devices having applications in subcutaneous delivery of a pharmaceutical composition of the present invention include, but are not limited to the SOLOSTAR™ pen (sanofi-aventis), the FLEXPEN™ (Novo Nordisk), and the KWIKPEN™ (Eli Lilly), the SURECLICK™ Autoinjector (Amgen, Thousand Oaks, Calif.), the PENLET™ (Haselmeier, Stuttgart, Germany), the EPIPEN (Dey, L. P.), and the HUMIRA™ Pen (Abbott Labs, Abbott Park Ill.), to name only a few.

In certain situations, the pharmaceutical composition can be delivered in a controlled release system. In one embodiment, a pump may be used (see Langer, supra; Sefton, 1987, CRC Crit. Ref. Biomed. Eng. 14:201). In another embodiment, polymeric materials can be used; see, Medical Applications of Controlled Release, Langer and Wise (eds.), 1974, CRC Pres., Boca Raton, Fla. In yet another embodiment, a controlled release system can be placed in proximity of the composition's target, thus requiring only a fraction of the systemic dose (see, e.g., Goodson, 1984, in Medical Applications of Controlled Release, supra, vol. 2, pp. 115-138). Other controlled release systems are discussed in the review by Langer, 1990, Science 249:1527-1533.

The injectable preparations may include dosage forms for intravenous, subcutaneous, intracutaneous and intramuscular injections, drip infusions, etc. These injectable preparations may be prepared by methods publicly known. For example, the injectable preparations may be prepared, e.g., by dissolving, suspending or emulsifying the antibody or its salt described above in a sterile aqueous medium or an oily medium conventionally used for injections. As the aqueous medium for injections, there are, for example, physiological saline, an isotonic solution containing glucose and other auxiliary agents, etc., which may be used in combination with an appropriate solubilizing agent such as an alcohol (e.g., ethanol), a polyalcohol (e.g., propylene glycol, polyethylene glycol), a nonionic surfactant [e.g., polysorbate 80, HCO-50 (polyoxyethylene (50 mol) adduct of hydrogenated castor oil)], etc. As the oily medium, there are employed, e.g., sesame oil, soybean oil, etc., which may be used in combination with a solubilizing agent such as benzyl benzoate, benzyl alcohol, etc. The injection thus prepared is preferably filled in an appropriate ampoule.

Advantageously, the pharmaceutical compositions for oral or parenteral use described above are prepared into dosage forms in a unit dose suited to fit a dose of the active ingredients. Such dosage forms in a unit dose include, for example, tablets, pills, capsules, injections (ampoules), suppositories, etc. The amount of the aforesaid antibody contained is generally about 5 to about 500 mg per dosage form in a unit dose; especially in the form of injection, it is preferred that the aforesaid antibody is contained in about 5 to about 100 mg and in about 10 to about 250 mg for the other dosage forms.

Therapeutic Uses of the Antigen-Binding Molecules

The present invention includes methods comprising administering to a subject in need thereof a therapeutic composition comprising an anti-STEAP2 antibody or antigen-binding fragment thereof, or a bispecific antigen-binding molecule that specifically binds CD3 and STEAP2. The therapeutic composition can comprise any of the antibodies or bispecific antigen-binding molecules as disclosed herein and a pharmaceutically acceptable carrier or diluent. As used herein, the expression "a subject in need thereof" means a human or non-human animal that exhibits one or more symptoms or indicia of cancer (e.g., a subject expressing a tumor or suffering from any of the cancers mentioned herein below), or who otherwise would benefit from an inhibition or reduction in STEAP2 activity or a depletion of STEAP2+ cells (e.g., prostate cancer cells).

The antibodies and bispecific antigen-binding molecules of the invention (and therapeutic compositions comprising the same) are useful, inter alia, for treating any disease or disorder in which stimulation, activation and/or targeting of an immune response would be beneficial. In particular, the anti-STEAP2 antibodies or the anti-CD3/anti-STEAP2 bispecific antigen-binding molecules of the present invention may be used for the treatment, prevention and/or amelioration of any disease or disorder associated with or mediated by STEAP2 expression or activity or the proliferation of STEAP2+ cells. The mechanism of action by which the therapeutic methods of the invention are achieved include killing of the cells expressing STEAP2 in the presence of effector cells, for example, by CDC, apoptosis, ADCC, phagocytosis, or by a combination of two or more of these mechanisms. Cells expressing STEAP2 which can be inhibited or killed using the bispecific antigen-binding molecules of the invention include, for example, prostate tumor cells.

The antigen-binding molecules of the present invention may be used to treat, e.g., primary and/or metastatic tumors arising in the prostate, bladder, cervix, lung, colon, kidney, breast, pancreas, stomach, uterus, and/or ovary. In certain embodiments, the bispecific antigen-binding molecules of the invention are used to treat one or more of the following cancers: prostate cancer, bladder cancer, cervical cancer, lung cancer, colon cancer, kidney cancer, breast cancer, pancreatic cancer, stomach cancer, uterine cancer, and ovarian cancer. According to certain embodiments of the present invention, the anti-STEAP2 antibodies or anti-STEAP2/anti-CD3 bispecific antibodies are useful for treating a patient afflicted with a castrate-resistant prostate cancer. According to other related embodiments of the invention, methods are provided comprising administering an anti-STEAP2 antibody or an anti-CD3/anti-STEAP2 bispecific antigen-binding molecule as disclosed herein to a patient who is afflicted with a castrate-resistant prostate cancer.

Analytic/diagnostic methods known in the art, such as tumor scanning, etc., may be used to ascertain whether a patient harbors a tumor that is castrate-resistant.

The present invention also includes methods for treating residual cancer in a subject. As used herein, the term "residual cancer" means the existence or persistence of one or more cancerous cells in a subject following treatment with an anti-cancer therapy.

According to certain aspects, the present invention provides methods for treating a disease or disorder associated with STEAP2 expression (e.g., prostate cancer) comprising administering one or more of the anti-STEAP2 or bispecific antigen-binding molecules described elsewhere herein to a subject after the subject has been determined to have prostate cancer (e.g., castrate-resistant prostate cancer). For example, the present invention includes methods for treating prostate cancer comprising administering an anti-STEAP2 antibody or an anti-CD3/anti-STEAP2 bispecific antigen-binding molecule to a patient 1 day, 2 days, 3 days, 4 days, 5 days, 6 days, 1 week, 2 weeks, 3 weeks or 4 weeks, 2 months, 4 months, 6 months, 8 months, 1 year, or more after the subject has received hormone therapy (e.g., anti-androgen therapy).

Combination Therapies and Formulations

The present invention provides methods which comprise administering a pharmaceutical composition comprising any of the exemplary antibodies and bispecific antigen-binding molecules described herein in combination with one or more additional therapeutic agents. Exemplary additional therapeutic agents that may be combined with or administered in combination with an antigen-binding molecule of the present invention include, e.g., an EGFR antagonist (e.g., an anti-EGFR antibody [e.g., cetuximab or panitumumab] or small molecule inhibitor of EGFR [e.g., gefitinib or erlotinib]), an antagonist of another EGFR family member such as Her2/ErbB2, ErbB3 or ErbB4 (e.g., anti-ErbB2, anti-ErbB3 or anti-ErbB4 antibody or small molecule inhibitor of ErbB2, ErbB3 or ErbB4 activity), an antagonist of EGFRvIII (e.g., an antibody that specifically binds EGFRvIII), a cMET anagonist (e.g., an anti-cMET antibody), an IGF1R antagonist (e.g., an anti-IGF1R antibody), a B-raf inhibitor (e.g., vemurafenib, sorafenib, GDC-0879, PLX-4720), a PDGFR-α inhibitor (e.g., an anti-PDGFR-α antibody), a PDGFR-3 inhibitor (e.g., an anti-PDGFR-3 antibody), a VEGF antagonist (e.g., a VEGF-Trap, see, e.g., U.S. Pat. No. 7,087,411 (also referred to herein as a "VEGF-inhibiting fusion protein"), anti-VEGF antibody (e.g., bevacizumab), a small molecule kinase inhibitor of VEGF receptor (e.g., sunitinib, sorafenib or pazopanib)), a DLL4 antagonist (e.g., an anti-DLL4 antibody disclosed in US 2009/0142354 such as REGN421), an Ang2 antagonist (e.g., an anti-Ang2 antibody disclosed in US 2011/0027286 such as H1H685P), a FOLH1 (PSMA) antagonist, a PRLR antagonist (e.g., an anti-PRLR antibody), a STEAP1 or STEAP2 antagonist (e.g., an anti-STEAP1 antibody or an anti-STEAP2 antibody), a TMPRSS2 antagonist (e.g., an anti-TMPRSS2 antibody), a MSLN antagonist (e.g., an anti-MSLN antibody), a CA9 antagonist (e.g., an anti-CA9 antibody), a uroplakin antagonist (e.g., an anti-uroplakin antibody), etc. Other agents that may be beneficially administered in combination with the antigen-binding molecules of the invention include cytokine inhibitors, including small-molecule cytokine inhibitors and antibodies that bind to cytokines such as IL-1, IL-2, IL-3, IL-4, IL-5, IL-6, IL-8, IL-9, IL-11, IL-12, IL-13, IL-17, IL-18, or to their respective receptors. The pharmaceutical compositions of the present invention (e.g., pharmaceutical compositions comprising an anti-CD3/anti-STEAP2 bispecific antigen-binding molecule as disclosed herein) may also be administered as part of a therapeutic regimen comprising one or more therapeutic combinations selected from "ICE": ifosfamide (e.g., Ifex®), carboplatin (e.g., Paraplatin®), etoposide (e.g., Etopophos®, Toposar®, VePesid®, VP-16); "DHAP": dexamethasone (e.g., Decadron®), cytarabine (e.g., Cytosar-U®, cytosine arabinoside, ara-C), cisplatin (e.g., Platinol®-AQ); and "ESHAP": etoposide (e.g., Etopophos®, Toposar®, VePesid®, VP-16), methylprednisolone (e.g., Medrol®), high-dose cytarabine, cisplatin (e.g., Platinol®-AQ).

The present invention also includes therapeutic combinations comprising any of the antigen-binding molecules mentioned herein and an inhibitor of one or more of VEGF, Ang2, DLL4, EGFR, ErbB2, ErbB3, ErbB4, EGFRvIII, cMet, IGF1R, B-raf, PDGFR-α, PDGFR-β, FOLH1 (PSMA), PRLR, STEAP1, STEAP2, TMPRSS2, MSLN, CA9, uroplakin, or any of the aforementioned cytokines, wherein the inhibitor is an aptamer, an antisense molecule, a ribozyme, an siRNA, a peptibody, a nanobody or an antibody fragment (e.g., Fab fragment; F(ab')$_2$ fragment; Fd fragment; Fv fragment; scFv; dAb fragment; or other engineered molecules, such as diabodies, triabodies, tetrabodies, minibodies and minimal recognition units). The antigen-binding molecules of the invention may also be administered and/or co-formulated in combination with antivirals, antibiotics, analgesics, corticosteroids and/or NSAIDs. The antigen-binding molecules of the invention may also be administered as part of a treatment regimen that also includes radiation treatment and/or conventional chemotherapy.

The additional therapeutically active component(s) may be administered just prior to, concurrent with, or shortly after the administration of an antigen-binding molecule of the present invention; (for purposes of the present disclosure, such administration regimens are considered the administration of an antigen-binding molecule "in combination with" an additional therapeutically active component).

The present invention includes pharmaceutical compositions in which an antigen-binding molecule of the present invention is co-formulated with one or more of the additional therapeutically active component(s) as described elsewhere herein.

Administration Regimens

According to certain embodiments of the present invention, multiple doses of an antigen-binding molecule (e.g., an anti-STEAP2 antibody or a bispecific antigen-binding molecule that specifically binds STEAP2 and CD3) may be administered to a subject over a defined time course. The methods according to this aspect of the invention comprise sequentially administering to a subject multiple doses of an antigen-binding molecule of the invention. As used herein, "sequentially administering" means that each dose of an antigen-binding molecule is administered to the subject at a different point in time, e.g., on different days separated by a predetermined interval (e.g., hours, days, weeks or months). The present invention includes methods which comprise sequentially administering to the patient a single initial dose of an antigen-binding molecule, followed by one or more secondary doses of the antigen-binding molecule, and optionally followed by one or more tertiary doses of the antigen-binding molecule.

The terms "initial dose," "secondary doses," and "tertiary doses," refer to the temporal sequence of administration of the antigen-binding molecule of the invention. Thus, the "initial dose" is the dose which is administered at the beginning of the treatment regimen (also referred to as the "baseline dose"); the "secondary doses" are the doses which are administered after the initial dose; and the "tertiary doses" are the doses which are administered after the secondary doses. The initial, secondary, and tertiary doses may all contain the same amount of the antigen-binding molecule, but generally may differ from one another in terms of frequency of administration. In certain embodiments, however, the amount of an antigen-binding molecule contained in the initial, secondary and/or tertiary doses varies from one another (e.g., adjusted up or down as appropriate) during the course of treatment. In certain embodiments, two or more (e.g., 2, 3, 4, or 5) doses are administered at the beginning of the treatment regimen as "loading doses" followed by subsequent doses that are administered on a less frequent basis (e.g., "maintenance doses").

In one exemplary embodiment of the present invention, each secondary and/or tertiary dose is administered 1 to 26 (e.g., 1, 1½, 2, 2½, 3, 3½, 4, 4½, 5, 5½, 6, 6½, 7, 7½, 8, 8½, 9, 9½, 10, 10½, 11, 11½, 12, 12½, 13, 13½, 14, 14½, 15, 15½, 16, 16½, 17, 17½, 18, 18½, 19, 19½, 20, 20½, 21, 21½, 22, 22½, 23, 23½, 24, 24½, 25, 25½, 26, 26½, or more) weeks after the immediately preceding dose. The phrase "the immediately preceding dose," as used herein, means, in a sequence of multiple administrations, the dose of antigen-binding molecule which is administered to a patient prior to the administration of the very next dose in the sequence with no intervening doses.

The methods according to this aspect of the invention may comprise administering to a patient any number of secondary and/or tertiary doses of an antigen-binding molecule (e.g., an anti-STEAP2 antibody or a bispecific antigen-binding molecule that specifically binds STEAP2 and CD3). For example, in certain embodiments, only a single secondary dose is administered to the patient. In other embodiments, two or more (e.g., 2, 3, 4, 5, 6, 7, 8, or more) secondary doses are administered to the patient. Likewise, in certain embodiments, only a single tertiary dose is administered to the patient. In other embodiments, two or more (e.g., 2, 3, 4, 5, 6, 7, 8, or more) tertiary doses are administered to the patient.

In embodiments involving multiple secondary doses, each secondary dose may be administered at the same frequency as the other secondary doses. For example, each secondary dose may be administered to the patient 1 to 2 weeks after the immediately preceding dose. Similarly, in embodiments involving multiple tertiary doses, each tertiary dose may be administered at the same frequency as the other tertiary doses. For example, each tertiary dose may be administered to the patient 2 to 4 weeks after the immediately preceding dose. Alternatively, the frequency at which the secondary and/or tertiary doses are administered to a patient can vary over the course of the treatment regimen. The frequency of administration may also be adjusted during the course of treatment by a physician depending on the needs of the individual patient following clinical examination.

Diagnostic Uses of the Antibodies

The anti-STEAP2 antibodies of the present invention may also be used to detect and/or measure STEAP2, or STEAP2-expressing cells in a sample, e.g., for diagnostic purposes. For example, an anti-STEAP2 antibody, or fragment thereof, may be used to diagnose a condition or disease characterized by aberrant expression (e.g., over-expression, under-expression, lack of expression, etc.) of STEAP2. Exemplary diagnostic assays for STEAP2 may comprise, e.g., contacting a sample, obtained from a patient, with an anti-STEAP2 antibody of the invention, wherein the anti-STEAP2 antibody is labeled with a detectable label or reporter molecule. Alternatively, an unlabeled anti-STEAP2 antibody can be used in diagnostic applications in combination with a secondary antibody which is itself detectably labeled. The detectable label or reporter molecule can be a radioisotope, such as $^{3}H$, $^{14}C$ $^{32}P$, $^{35}S$, or $^{125}I$; a fluorescent or chemiluminescent moiety such as fluorescein isothiocyanate, or rhodamine; or an enzyme such as alkaline phosphatase, beta-galactosidase, horseradish peroxidase, or luciferase. Another exemplary diagnostic use of the anti-STEAP2 antibodies of the invention includes $^{89}Zr$-labeled, such as $^{89}Zr$-desferrioxamine-labeled, antibody for the purpose of non-invasive identification and tracking of tumor cells in a subject (e.g. positron emission tomography (PET) imaging). (See, e.g., Tavare, R. et al. Cancer Res. 2016 Jan. 1; 76(1):73-82; and Azad, B B. et al. Oncotarget. 2016 Mar. 15; 7(11):12344-58.) Specific exemplary assays that can be used to detect or measure STEAP2 in a sample include enzyme-linked immunosorbent assay (ELISA), radioimmunoassay (RIA), and fluorescence-activated cell sorting (FACS).

Samples that can be used in STEAP2 diagnostic assays according to the present invention include any tissue or fluid sample obtainable from a patient which contains detectable quantities of STEAP2 protein, or fragments thereof, under normal or pathological conditions. Generally, levels of STEAP2 in a particular sample obtained from a healthy patient (e.g., a patient not afflicted with a disease or condition associated with abnormal STEAP2 levels or activity) will be measured to initially establish a baseline, or standard, level of STEAP2. This baseline level of STEAP2 can then be compared against the levels of STEAP2 measured in samples obtained from individuals suspected of having a STEAP2 related disease (e.g., a tumor containing STEAP2-expressing cells) or condition.

EXAMPLES

The following examples are put forth so as to provide those of ordinary skill in the art with a complete disclosure and description of how to make and use the methods and compositions of the invention, and are not intended to limit the scope of what the inventors regard as their invention. Efforts have been made to ensure accuracy with respect to numbers used (e.g., amounts, temperature, etc.) but some experimental errors and deviations should be accounted for. Unless indicated otherwise, parts are parts by weight, molecular weight is average molecular weight, temperature is in degrees Centigrade, and pressure is at or near atmospheric.

Example 1: Generation of Anti-STEAP2 Antibodies

Anti-STEAP2 antibodies were obtained by immunizing a genetically modified mouse with a human STEAP2 antigen or by immunizing an engineered mouse comprising DNA encoding human immunoglobulin heavy and kappa light chain variable regions with a human STEAP2 antigen.

Genetically modified mice were immunized with hSTEAP2 antigen (SEQ ID:1899). Following immunization, splenocytes were harvested from each mouse and either (1) fused with mouse myeloma cells to preserve their viability and form hybridoma cells and screened for STEAP2 specificity, or (2) B-cell sorted (as described in US 2007/0280945A1) using a human STEAP2 fragment as the sorting reagent that binds and identifies reactive antibodies (antigen-positive B cells).

Chimeric antibodies to STEAP2 were initially isolated having a human variable region and a mouse constant region. The antibodies were characterized and selected for desirable characteristics, including affinity, selectivity, etc. If necessary, mouse constant regions were replaced with a desired human constant region, for example wild-type or modified IgG1 or IgG4 constant region, to generate a fully human anti-STEAP2 antibody. While the constant region selected may vary according to specific use, high affinity antigen-binding and target specificity characteristics reside in the variable region. The antibody name designations such as H1H11243N and H1M7804N denote fully human antibodies "H1H" or chimeric human variable/mouse constant region antibodies "H1M". Antibodies identified by the hybridoma method are indicated with antibody ID numbers ending with "N" or "N2"; Antibodies identified by the B-cell sorting method are indicated with antibody ID numbers ending with "P" or "P2".

Certain biological properties of the exemplary anti-STEAP2 antibodies generated in accordance with the methods of this Example are described in detail in the Examples set forth below.

Heavy and Light Chain Variable Region Amino Acid and Nucleic Acid Sequences of Anti-STEAP2 Antibodies Table 1 sets forth the amino acid sequence identifiers of the heavy and light chain variable regions and CDRs of selected anti-STEAP2 antibodies of the invention. The corresponding nucleic acid sequence identifiers are set forth in Table 2.

TABLE 1

Amino Acid Sequence Identifiers

| Antibody Designation | SEQ ID NOs: | | | | | | | |
|---|---|---|---|---|---|---|---|---|
| | HCVR | HCDR1 | HCDR2 | HCDR3 | LCVR | LCDR1 | LCDR2 | LCDR3 |
| H1H11243N | 2 | 4 | 6 | 8 | 10 | 12 | 14 | 16 |
| H1H11878P | 18 | 20 | 22 | 24 | 26 | 28 | 30 | 32 |
| H1H11880P | 34 | 36 | 38 | 40 | 42 | 44 | 46 | 48 |
| H1H11888P2 | 50 | 52 | 54 | 56 | 58 | 60 | 62 | 64 |
| H1H11892P2 | 66 | 68 | 70 | 72 | 58 | 60 | 62 | 64 |
| H1H11893P2 | 74 | 76 | 78 | 80 | 58 | 60 | 62 | 64 |
| H1H11894P2 | 82 | 84 | 86 | 88 | 58 | 60 | 62 | 64 |
| H1H11895P2 | 90 | 92 | 94 | 96 | 58 | 60 | 62 | 64 |
| H1H11896P2 | 98 | 100 | 102 | 104 | 58 | 60 | 62 | 64 |
| H1H11897P2 | 106 | 108 | 110 | 112 | 114 | 116 | 118 | 120 |
| H1H7968P | 122 | 124 | 126 | 128 | 130 | 132 | 134 | 136 |
| H1H7969P | 138 | 140 | 142 | 144 | 146 | 148 | 150 | 152 |
| H1H7970P | 154 | 156 | 158 | 160 | 162 | 164 | 166 | 168 |
| H1H7971P | 170 | 172 | 174 | 176 | 178 | 180 | 182 | 184 |
| H1H7972P | 186 | 188 | 190 | 192 | 194 | 196 | 198 | 200 |
| H1M7804N | 202 | 204 | 206 | 208 | 210 | 212 | 214 | 216 |
| H1M7814N | 218 | 220 | 222 | 224 | 226 | 228 | 230 | 232 |
| H1M7832N | 234 | 236 | 238 | 240 | 242 | 244 | 246 | 248 |
| H2M11162N | 250 | 252 | 254 | 256 | 258 | 260 | 262 | 264 |
| H2M11163N | 266 | 268 | 270 | 272 | 274 | 276 | 278 | 280 |
| H2M11164N | 282 | 284 | 286 | 288 | 290 | 292 | 294 | 296 |
| H2M7806N | 298 | 300 | 302 | 304 | 306 | 308 | 310 | 312 |
| H2M7807N | 314 | 316 | 318 | 320 | 322 | 324 | 326 | 328 |
| H2M7809N | 330 | 332 | 334 | 336 | 338 | 340 | 342 | 344 |
| H2M7810N | 346 | 348 | 350 | 352 | 354 | 356 | 358 | 360 |
| H2M7811N | 362 | 364 | 366 | 368 | 370 | 372 | 374 | 376 |
| H2M7812N | 378 | 380 | 382 | 384 | 386 | 388 | 390 | 392 |

TABLE 2

Nucleic Acid Sequence Identifiers

| Antibody Designation | SEQ ID NOs: | | | | | | | |
|---|---|---|---|---|---|---|---|---|
| | HCVR | HCDR1 | HCDR2 | HCDR3 | LCVR | LCDR1 | LCDR2 | LCDR3 |
| H1H11243N | 1 | 3 | 5 | 7 | 9 | 11 | 13 | 15 |
| H1H11878P | 17 | 19 | 21 | 23 | 25 | 27 | 29 | 31 |
| H1H11880P | 33 | 35 | 37 | 39 | 41 | 43 | 45 | 47 |
| H1H11888P2 | 49 | 51 | 53 | 55 | 57 | 59 | 61 | 63 |
| H1H11892P2 | 65 | 67 | 69 | 71 | 57 | 59 | 61 | 63 |
| H1H11893P2 | 73 | 75 | 77 | 79 | 57 | 59 | 61 | 63 |
| H1H11894P2 | 81 | 83 | 85 | 87 | 57 | 59 | 61 | 63 |
| H1H11895P2 | 89 | 91 | 93 | 95 | 57 | 59 | 61 | 63 |
| H1H11896P2 | 97 | 99 | 101 | 103 | 57 | 59 | 61 | 63 |
| H1H11897P2 | 105 | 107 | 109 | 111 | 113 | 115 | 117 | 119 |
| H1H7968P | 121 | 123 | 125 | 127 | 129 | 131 | 133 | 135 |
| H1H7969P | 137 | 139 | 141 | 143 | 145 | 147 | 149 | 151 |
| H1H7970P | 153 | 155 | 157 | 159 | 161 | 163 | 165 | 167 |
| H1H7971P | 169 | 171 | 173 | 175 | 177 | 179 | 181 | 183 |
| H1H7972P | 185 | 187 | 189 | 191 | 193 | 195 | 197 | 199 |
| H1M7804N | 201 | 203 | 205 | 207 | 209 | 211 | 213 | 215 |

TABLE 2-continued

| | Nucleic Acid Sequence Identifiers | | | | | | | |
|---|---|---|---|---|---|---|---|---|
| Antibody | SEQ ID NOs: | | | | | | | |
| Designation | HCVR | HCDR1 | HCDR2 | HCDR3 | LCVR | LCDR1 | LCDR2 | LCDR3 |
| H1M7814N | 217 | 219 | 221 | 223 | 225 | 227 | 229 | 231 |
| H1M7832N | 233 | 235 | 237 | 239 | 241 | 243 | 245 | 247 |
| H2M11162N | 249 | 251 | 253 | 255 | 257 | 259 | 261 | 263 |
| H2M11163N | 265 | 267 | 269 | 271 | 273 | 275 | 277 | 279 |
| H2M11164N | 281 | 283 | 285 | 287 | 289 | 291 | 293 | 295 |
| H2M7806N | 297 | 299 | 301 | 303 | 305 | 307 | 309 | 311 |
| H2M7807N | 313 | 315 | 317 | 319 | 321 | 323 | 325 | 327 |
| H2M7809N | 329 | 331 | 333 | 335 | 337 | 339 | 341 | 343 |
| H2M7810N | 345 | 347 | 349 | 351 | 353 | 355 | 357 | 359 |
| H2M7811N | 361 | 363 | 365 | 367 | 369 | 371 | 373 | 375 |

Example 2: Anti-Human STEAP2 Antibodies Selectively Bind to STEAP2 Expressing Cell Lines Via FACS The ability of anti-STEAP2 antibodies to selectively bind to human six-transmembrane epithelial antigen of prostate 2 (STEAP2) endogenously expressing cell lines was determined via FACS analysis.

Briefly, $1\times10^5$ cells were incubated with 10 μg/ml of anti STEAP2 antibodies, or isotype control antibodies for 30 min on ice in antibody dilution buffer. Following one wash with antibody dilution buffer, cells were incubated with 10 μg/ml of PE conjugated anti-human or anti mouse Fc secondary antibodies for 30 min on ice. Following one additional wash, samples were incubated with Cytofix (1% formaldehyde) for 20 minutes. After one final wash, samples were filtered through a Pall 96 well filtration block, run on a Hypercyt® cytometer and analyzed in ForeCyt™ (IntelliCyt, Albuquerque, N. Mex.). Mean fluorescence intensities (MFI) were expressed as fold change above unstained levels (background). The average fold above background at antibody concentrations of 100-300 nM were determined. For cell binding EC50 determinations, mAb concentrations ranged from 300 nM to 5 μM and EC50 values were determined from a four-parameter logistic equation over a 12-point response curve (GraphPad Prism).

Tables 3A and 3B: FACS Binding Properties of Anti-STEAP2 Antibodies to STEAP2-expressing and STEAP2 negative cell lines

TABLE 3A

| Binding Properties of Selected Human-Fc Anti-STEAP2 Antibodies | | | | | | |
|---|---|---|---|---|---|---|
| | STEAP2 Expressing | | | STEAP2 Negative | | |
| Cell line | HEK293 | C4-2 | | FADU | SKBR3 | Raji |
| Antibody | Avg F.A.B | Avg F.A.B | Avg EC$_{50}$ (nM) | Avg F.A.B | Avg F.A.B | Avg F.A.B |
| H1H7809N | 31 | 89 | >50 | 21 | 37 | 3 |
| H1H7810N | 3 | 26 | ND | 3 | 3 | 2 |
| H1H7811N | 5 | 65 | >50 | 3 | 5 | 4 |
| H1H7814N | 2 | 96 | 4 | 2 | 2 | 2 |
| H1H7972P | 4 | 119 | 9 | 2 | 3 | 59 |
| H1H11162N | 10 | 104 | 1 | 3 | 3 | 2 |
| H1H11163N | 6 | 90 | 3 | 2 | 3 | 2 |
| H1H11164N | 10 | 117 | 2 | 3 | 2 | 2 |
| H1H11243N | 3 | 41 | ND | 2 | 3 | 2 |
| H1H11878P | 5 | 27 | >50 | ND | ND | ND |
| H1H11880P | 7 | 6 | 5 | ND | ND | ND |
| H1H11888P2 | 9 | 6 | 3 | ND | ND | ND |
| H1H11892P2 | 3 | 4 | ND | ND | ND | ND |
| H1H11893P2 | 3 | 9 | 21 | ND | ND | ND |
| H1H11894P2 | 4 | 7 | ND | ND | ND | ND |
| H1H11895P2 | 4 | 6 | 16 | ND | ND | ND |
| H1H11896P2 | 7 | 6 | 21 | ND | ND | ND |
| H1H11897P2 | 16 | 29 | >50 | ND | ND | ND |
| hIgG1 Isotype Control-I | 1 | 2 | ND | 1 | 2 | 4 |
| hIgG1 Isotype Control-II | 1.7 ± 0.5 | 2 | ND | 3 | 2 | ND |
| anti-human PE | 1.1 ± 0.1 | 1 | ND | 1 | 2 | 1 |
| Unstained | 1 ± 0 | 1 | ND | 1 | 1 | ND |

F.A.B.: Fold Above Background;
ND: Not Detected

TABLE 3B

Binding Properties of Anti-STEAP2 Hybridoma-generated Antibodies

| | STEAP2 Expressing | | | STEAP2 Negative | | |
|---|---|---|---|---|---|---|
| Cell line | HEK293 | C4-2 | | FADU | SKBR3 | Raji |
| Antibody | Avg F.A.B | Avg F.A.B | Avg EC$_{50}$ (nM) | Avg F.A.B | Avg F.A.B | Avg F.A.B |
| H1M11243N | ND | 116 | 23 | ND | ND | ND |
| H1M11249N | ND | 11 | ND | ND | ND | ND |
| H2M11160N | ND | 8 | ND | ND | ND | ND |
| H2M11162N | ND | 365 | 4.9 | ND | ND | ND |
| H2M11163N | ND | 256 | 13 | ND | ND | ND |
| H2M11164N | ND | 360 | 3.7 | ND | ND | ND |
| H2M11166N | ND | 12 | ND | ND | ND | ND |
| H2M11168N | ND | 9 | ND | ND | ND | ND |
| H2M11245N | ND | 18 | ND | ND | ND | ND |
| H2M11246N | ND | 11 | ND | ND | ND | ND |
| H2M11247N | ND | 482 | 18 | ND | ND | ND |
| H2M11248N | ND | 50 | >50 | ND | ND | ND |
| H3M11161N | ND | 5 | ND | ND | ND | ND |
| H3M11165N | ND | 13 | ND | ND | ND | ND |
| H3M11167N | ND | 14 | ND | ND | ND | ND |
| H3M11244N | ND | 2 | ND | ND | ND | ND |
| mIgG1 Isotype Control | ND | 2 | ND | ND | ND | ND |
| mIgG2 Isotype Control | ND | 3 | ND | ND | ND | ND |
| mIgG3 Isotype Control | ND | 4 | ND | ND | ND | ND |
| anti-human PE | 1.1 ± 0.1 | 1 | ND | 1 | 2 | 1 |
| Unstained | 1 ± 0 | 1 | ND | 1 | 1 | ND |

F.A.B.: Fold Above Background;
ND: Not Detected

As the results in Tables 3A and 3B demonstrate, several anti-STEAP2 antibodies specifically bound to high-STEAP2 expressing C4-2 prostate adenocarcinoma cell lines at levels greater than 50-fold above background, with low nM EC50s, via FACS. Some anti-STEAP2 antibodies also bound weakly to low-STEAP2-expressing HEK293 cells. Negligible binding was observed for most anti-STEAP2 antibodies on STEAP2-negative FADU, SK-BR-3, and Raji cells. This example illustrates the ability of several anti-STEAP2 antibodies of this invention to specifically and selectively bind to high-expressing STEAP2 cell lines.

Example 3: Anti-Human STEAP2 Antibodies Show Potent Internalization and Specificity for Human-STEAP2

The ability of the anti-STEAP2 antibodies of this invention to selectively bind to STEAP2-expressing cell lines has been described (see Example 2—FACS binding). Next, the internalization properties of the anti-STEAP2 antibodies of this invention were also assessed.

Briefly, 20,000 C4-2 cells were seeded in PDL coated 96 well plates. The next day, cells were incubated with anti-human STEAP2 antibodies (10 µg/ml) for 30 min on ice followed by two PBS washes. Cells were then incubated with alexa488-conjugated anti-hFc Fab secondary antibody for 30 minutes on ice, followed by two additional PBS washes. Antibodies were allowed to internalize for 1 h at 37° C. in internalization buffer (PBS+2% FBS) or were maintained at 4° C. Cells were fixed in 4% formaldehyde, nuclei were stained with DRAQ5 (Cell signaling), and images were acquired on the ImageXpress micro XL (Molecular Devices).

A qualitative visual assessment of the total binding intensity and the intensity of antibodies that had internalized into vesicles was performed and scored according to the following criteria: − (no internalization or binding), +(weak internalization or binding), ++(moderate internalization or binding) and +++(robust internalization or binding).

As the results in Table 4 illustrate, several antibodies showed robust internalization capabilities on the C4-2 cell line. In general, robust internalization correlated with the highest levels of total binding intensity.

Selected STEAP2 antibodies were then tested for binding to other human (h) STEAP family members (STEAP1, STEAP3, and STEAP4). To assess anti STEAP2 antibody specificity, plasmid constructs expressing hSTEAP1, hSTEAP2, hSTEAP3 or hSTEAP4 fused to Green Fluorescent Protein (GFP) were transiently introduced into HEK293 cells via lipofectamine 2000 based methodology. After 48 h, transiently transfected cells were stained with anti STEAP2 antibodies and imaged as described above for the internalization assay. Wells with GFP positive cells that bound anti STEAP2 antibodies were scored as positive (+) and those that did not bind anti STEAP2 antibodies were scored as negative (−). All tested antibodies bound hSTEAP2-GFP positive cells but did not bind STEAP1-GFP, STEAP3-GFP, or STEAP4-GFP positive cells, confirming specificity of binding to human STEAP2. The results are summarized in Table 5.

In summary, several anti-STEAP2 antibodies of this invention demonstrate potent internalization ability and are specific binders to human STEAP2.

TABLE 4

Qualitative assessment of internalization and total binding properties of Anti-STEAP2 antibodies on high-STEAP2 expressing C4-2 cell line

| Antibody | Internalization (37° C., 1 h) Qualitative Score | Total Binding (4° C.) Qualitative Score |
|---|---|---|
| H1H7814N | + | + |
| H1H11162N | +++ | +++ |
| H1H11163N | ++ | ++ |
| H1H11164N | +++ | +++ |
| H1H11878P | + | + |
| H1H11880P | + | + |
| H1H11888P2 | + | + |
| H1H11892P2 | +/− | +/− |
| H1H11893P2 | +/− | +/− |
| H1H11894P2 | +/− | + |
| H1H11895P2 | + | + |
| H1H11896P2 | + | + |
| H1H11897P2 | − | − |
| H1H7972P | + | + |
| H1M11243N | + | + |
| H2M11162N | +++ | +++ |
| H2M11163N | ++ | ++ |
| H2M11164N | +++ | +++ |
| H2M11247N | +++ | +++ |
| higG1 Isotype Control (Ab to irrelevant antigen) | − | − |

TABLE 5

Specificity of anti-STEAP2 Antibodies: Assessment of Binding to hSTEAP1, hSTEAP2, hSTEAP3 or hSTEAP4 fused to GFP

| | HEK293 Cells Transfected with STEAP/GFP fusion Plasmids | | | |
|---|---|---|---|---|
| Antibodies | hSTEAP1 | hSTEAP2 | hSTEAP3 | hSTEAP4 |
| H2M7807 | − | + | − | − |
| H2M7810 | − | + | − | − |
| H2M7811 | − | + | − | − |
| H1M7814 | − | + | − | − |
| H1H7972 | − | + | − | − |

Example 4: Generation of Bispecific Antibodies that Bind STEAP2 and CD3

The present invention provides bispecific antigen-binding molecules that bind CD3 and STEAP2; such bispecific antigen-binding molecules are also referred to herein as "anti-STEAP2/anti-CD3 or anti-STEAP2×CD3 bispecific molecules". The anti-STEAP2 portion of the anti-STEAP2/anti-CD3 bispecific molecule is useful for targeting tumor cells that express six-transmembrane epithelial antigen of prostate 2 (STEAP2) (STEAP2), and the anti-CD3 portion of the bispecific molecule is useful for activating T-cells. The simultaneous binding of STEAP2 on a tumor cell and CD3 on a T-cell facilitates directed killing (cell lysis) of the targeted tumor cell by the activated T-cell.

Bispecific antibodies comprising an anti-STEAP2-specific binding domain and an anti-CD3-specific binding domain were recombinantly constructed by standard molecular cloning methodologies and expressed in CHO cells, wherein the anti-STEAP2 antigen binding domain and the anti-CD3 antigen binding domain each comprise different, distinct HCVRs paired with a common LCVR. In exemplified bispecific antibodies, the molecules were constructed utilizing a heavy chain from an anti-CD3 antibody, a heavy chain from an anti-STEAP2 antibody and a common light chain from the anti-STEAP2 antibody, and expressed in CHO cells. In some instances, the bispecific antibodies may be constructed utilizing a heavy chain from an anti-CD3 antibody, a heavy chain from an anti-STEAP2 antibody and a light chain from an anti-CD3 antibody or an antibody light chain known to be promiscuous or pair effectively with a variety of heavy chain arms, such as VK1-39JK5 or VK3-20JK1.

The bispecific antibodies described in the following examples consist of anti-CD3 binding arms having varying binding affinities to human soluble heterodimeric hCD3$_\epsilon$/δ protein (as described in Example 12 herein); and human STEAP2 (see Examples 1-2 above). Exemplified bispecific antibodies were manufactured having a modified (chimeric) IgG4 Fc domain as set forth in US Patent Application Publication No. US20140243504A1, published on Aug. 28, 2014.

A summary of the component parts of the antigen-binding domains of the various anti-STEAP2×CD3 bispecific antibodies constructed is set forth in Table 6.

TABLE 6

Construction of STEAP2 × CD3 Bispecific Antibodies

| Bispecific Antibody Identifier | Anti-STEAP2 Antigen-Binding Domain Heavy Chain Variable Region | Anti-CD3 Antigen-Binding Domain Heavy Chain Variable Region | Common Light Chain Variable Region |
|---|---|---|---|
| BSSTEAP2/CD3-001 | H2M11162N (SEQ ID NO: 250) | CD3-VH-G (SEQ ID NO: 1730) | H2M11162N (SEQ ID NO: 258) |
| BSSTEAP2/CD3-002 | | CD3-VH-G5 (SEQ ID NO: 1762) | |
| BSSTEAP2/CD3-003 | | CD3-VH-G20 (SEQ ID NO: 1866) | |
| BSSTEAP2/CD3-004 | H1H7814N (SEQ ID NO: 218) | H1H7251P (SEQ ID NO: 1570) | H1H7814N (SEQ ID NO: 226) |
| BSSTEAP2/CD3-005 | H1H11162 (SEQ ID NO: 250) | H1H7208P (SEQ ID NO: 1490) | H1H11162 (SEQ ID NO: 258) |
| BSSTEAP2/CD3-006 | | CD3-VH-P (SEQ ID NO: 1882) | |
| BSSTEAP2/CD3-007 | | H1H7195P (SEQ ID NO: 1450) | |

TABLE 6-continued

Construction of STEAP2 × CD3 Bispecific Antibodies

| Bispecific Antibody Identifier | Anti-STEAP2 Antigen-Binding Domain Heavy Chain Variable Region | Anti-CD3 Antigen-Binding Domain Heavy Chain Variable Region | Common Light Chain Variable Region |
|---|---|---|---|
| BSSTEAP2/CD3-008 | H1H11163 (SEQ ID NO: 266) | H1H7208P (SEQ ID NO: 1490) | H1H11163 (SEQ ID NO: 274) |
| BSSTEAP2/CD3-009 | H1H11164 (SEQ ID NO: 282) | H1H7208P (SEQ ID NO: 1490) | H1H11164 (SEQ ID NO: 290) |
| BSSTEAP2/CD3-010 | H1H7809N (SEQ ID NO: 330) | H1H7198P (SEQ ID NO: 1466) | H1H7809N (SEQ ID NO: 339) |
| BSSTEAP2/CD3-011 | | H1H7203P (SEQ ID NO: 1474) | |

The light chains listed in Table 6 were common to both the CD3 and STEAP2 targeting arms of the bispecific antibodies. Tables 1 and 2 set out amino acid and nucleic acid sequence identifiers, respectively, for the various heavy chain variable regions, and their corresponding CDRs, of the anti-STEAP2 arms (i.e. HCVR and LCVR are derived from H2M11162N) to construct the bispecific antibodies of this Example. Table 15 and 16 set out amino acid and nucleic acid sequence identifiers, respectively, for the various heavy chain variable regions, and their corresponding CDRs, of the anti-CD3 arms of the bispecific antibodies of this Example.

Example 5: Anti-STEAP2/Anti-CD3 Bispecific Antibodies Display Potent Anti-Tumor Efficacy In Vivo To determine the efficacy of exemplary anti-STEAP2/anti-CD3 bispecific antibodies in vivo, studies were performed in immune-compromised mice bearing prostate cancer xenografts.

Efficacy of Anti-STEAP2/Anti-CD3 Bispecific Antibodies in Human Tumor Xenograft Models To assess the in vivo efficacy of the anti-STEAP2/anti-CD3 bispecifics in human tumor xenograft studies, NOD scid gamma (NSG) mice (Jackson Laboratories, Bar Harbor, Me.) were co-implanted with human peripheral blood mononuclear cells (PBMCs; ReachBio LLC., Seattle, Wash.) along with human prostate cancer C4-2 cells (MD Anderson Cancer Center, Houston Tex.) which endogenously express STEAP2.

Briefly, $5.0 \times 10^6$ C4-2 cells were co-implanted subcutaneously (s.c.) with $1.25 \times 10^6$ human PBMCs in a 50:50 mix of matrigel matrix (BD Biosciences, San Jose, Calif.) into the right flank of male NSG mice. Mice were treated intraperitoneally (i.p.) on the day of implantation (immediate treatment model) with anti-STEAP2/anti-CD3 bispecifics BSSTEAP2/CD3-001, BSSTEAP2/CD3-002 or BSSTEAP2/CD3-003, or an isotype control, at a dose of 0.1 or 0.01 mg/kg (N=5 mice/group).

Tumor size was measured 2×/week using calipers and tumor volume calculated as Volume=(length×width$^2$)/2. Data is shown as tumor size (mm$^3$) at study endpoint, 46 d post-tumor implantation (Table 7).

TABLE 7

Efficacy of anti-STEAP2/anti-CD3 Bispecific Antibodies in Immune-Compromised Xenograft Model: Immediate Dosing

| Tumor Model/ Mouse Strain | Bispecific Antibody Identifier | Dose (mg/kg) | N | Tumor Size (mm$^3$) 46 d post-tumor implantation (mean ± SD) |
|---|---|---|---|---|
| C4-2/ NSG | BSSTEAP2/CD3-001 | 0.1 | 5 | 18.0 ± 14.0 |
| | | 0.01 | 5 | 23.0 ± 220 |
| | BSSTEAP2/CD3-002 | 0.1 | 5 | 15.0 ± 12.0 |
| | | 0.01 | 5 | 17.0 ± 8.0 |
| | BSSTEAP2/CD3-003 | 0.1 | 5 | 19.0 ± 12.0 |
| | | 0.01 | 5 | 25.0 ± 21.0 |
| | Control Bispecific | 0.1 | 5 | 1020.0 ± 922.0 |

As the results in Table 7 show, BSSTEAP2/CD3-001, BSSTEAP2/CD3-002 and BSSTEAP2/CD3-003 significantly suppressed tumor growth compared to an isotype control when tumor sizes were measured at study endpoint. Importantly, the anti-STEAP2/anti-CD3 bispecific antibodies were efficacious in inhibiting C4-2 tumor growth even at the lowest dose of 0.1 mg/kg.

Example 6: Conjugate Preparation and Characterization

All the monoclonal antibodies were expressed in CHO cells and purified by Protein A. An isotype control was also prepared in a similar fashion. The non-binding isotype control antibody was derived from an immunological antigen having no relation to oncology.

The antibody (10 mg/ml) in 50 mM HEPES, 150 mM NaCl, pH 7.5, was treated with 1 mM dithiothreitol at 37° C. for 30 min. After gel filtration (G-25, pH 4.5 sodium acetate), the maleimido linker payload derivative Compound 7 (1.2 equivalents/SH group) in DMSO (10 mg/ml) was added to the reduced antibody and the mixture adjusted to pH 7.0 with 1 M HEPES (pH 7.4). Compound 7, and methods of making the compound, is described in PCT Publication No. WO2014/145090, published on Sep. 18, 2014, which is entirely incorporated herein by reference. After 1 h the reaction was quenched with excess N-ethyl maleimide. The conjugates were purified by size exclusion chromatography and sterile filtered. Protein and linker payload concentrations were determined by UV spectral analysis. Size-exclusion HPLC established that all conjugates used were >95% monomeric, and RP-HPLC established that there was <0.5% unconjugated linker payload. Yields are reported in Table 8 based on protein titer determination. All conjugated antibodies were analyzed by UV for linker payload loading values according to Hamblett et al, Cancer Res 2004 10 7063. The results are summarized in Table 8.

A conjugate comprising Compound 60 can be prepared using a similar method. Compound 60, and methods of making the compound, is described in PCT Publication No. WO2016/160615 (Example 20), published on Oct. 6, 2016, which is entirely incorporated herein by reference. Compound 60 is Maytansin-N-methyl-L-alanine-(3-methoxy-4-amino)benzamido-Cit-Val-Cap-Mal.

TABLE 8

Summary of Payload (Chemotoxic Drug) and Antibody-Drug-Conjugate Parameters

| Compound 7 | $\varepsilon 252$ nm $(cm^{-1} M^{-1})$ | $\varepsilon 280$ nm $(cm^{-1} M^{-1})$ |
|---|---|---|
| [Maytansin-3-N-methyl-L-(S)-alanine-propanamidyl-3-N-methyl-N-[4-(amino-citrulline-valine-hexanamide-6-maleimidyl)benzyl]carbamate] | 50600 | 8100 |

| Antibody | $\varepsilon 252$ nm $(cm^{-1} M^{-1})$ | $\varepsilon 280$ nm $(cm^{-1} M^{-1})$ |
|---|---|---|
| H1H7814N | 110440 | 212400 |
| Isotype Control | 75113 | 218360 |

| Antibody Conjugate | Payload:Antibody (UV) | Yield % |
|---|---|---|
| H1H7814N-7 | 2.7 | 48 |
| Isotype Control-7 | 3.0 | 48 |

Example 7: Anti-STEAP2 Antibody Drug Conjugates (ADCs) are Potent Inhibitors of Tumor Growth in In Vivo STEAP2 Positive Prostate Cancer Xenograft Models A. To determine the in vivo efficacy of anti-STEAP2 antibodies conjugated to Compound 7, studies were performed in immune-compromised mice bearing STEAP2 positive prostate cancer xenografts.

For these studies, Male SCID mice (Taconic, Hudson N.Y.) were implanted with C4-2 cells endogenously expressing STEAP2. Once tumors had reached an average volume of 200-250 mm$^3$ (~Day 13-17), mice were randomized into treatment groups, and dosed with either anti-STEAP2 conjugated antibodies, a non-binding conjugated antibody or vehicle. In these in vivo studies, antibodies were dosed once and tumors were then monitored until an average tumor size of approximately 1500-2000 mm$^3$ was attained in the cohort dosed with vehicle alone (~40-50 days). Treatment groups showing efficacy were maintained for a longer period of time (80-110 days).

In an initial study, an exemplary anti-STEAP2 antibody conjugated to Compound 7 was examined for efficacy in reducing C4-2 tumor volume. Mice received a single dose of anti-STEAP2 and control ADCs at 10, 20 or 40 mg/kg on day 13 after implantation. As summarized in FIG. 1, H1H7841N-7 (DAR 2.92) potently inhibited tumor growth at all doses tested. At the highest dose (40 mg/kg), H1H784N-7 efficiently reduced tumor size, although the non-binding control antibody (40 mg/kg) also showed an effect on tumor volume. Across all the doses investigated, H1H784N-7 reduced tumor size more potently than the control conjugated antibody.

Figure 2:
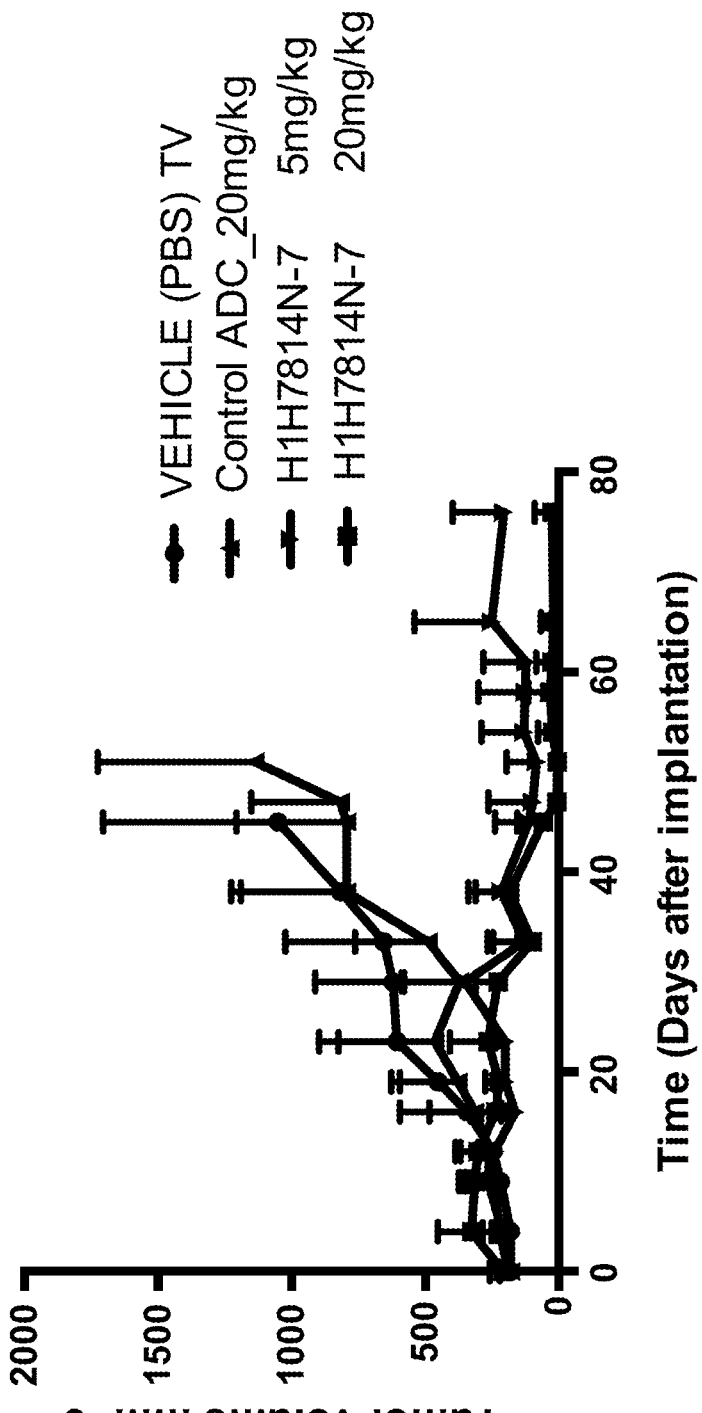
FIG. 2 shows efficacy of H1H7814N-7 in a STEAP2 positive prostate cancer xenograft model (SCID mice implanted with C4-2 cells) at a dose of 20 mg/kg H1H7814N-7 administered on day 14 after implantation.

In a second study, anti-STEAP2 ADC was administered at 5 and 20 mg/kg and the control antibody at 20 mg/kg on day 14 after implantation. As summarized in FIG. 2, H1H7841N-7 (DAR 2.92) potently inhibited tumor growth at the 20 mg/kg dose as in the previous experiment, but showed reduced efficacy at the 5 mg/kg dose. The control antibody at the 20 mg/kg dose showed no difference to vehicle control.

Figure 3:
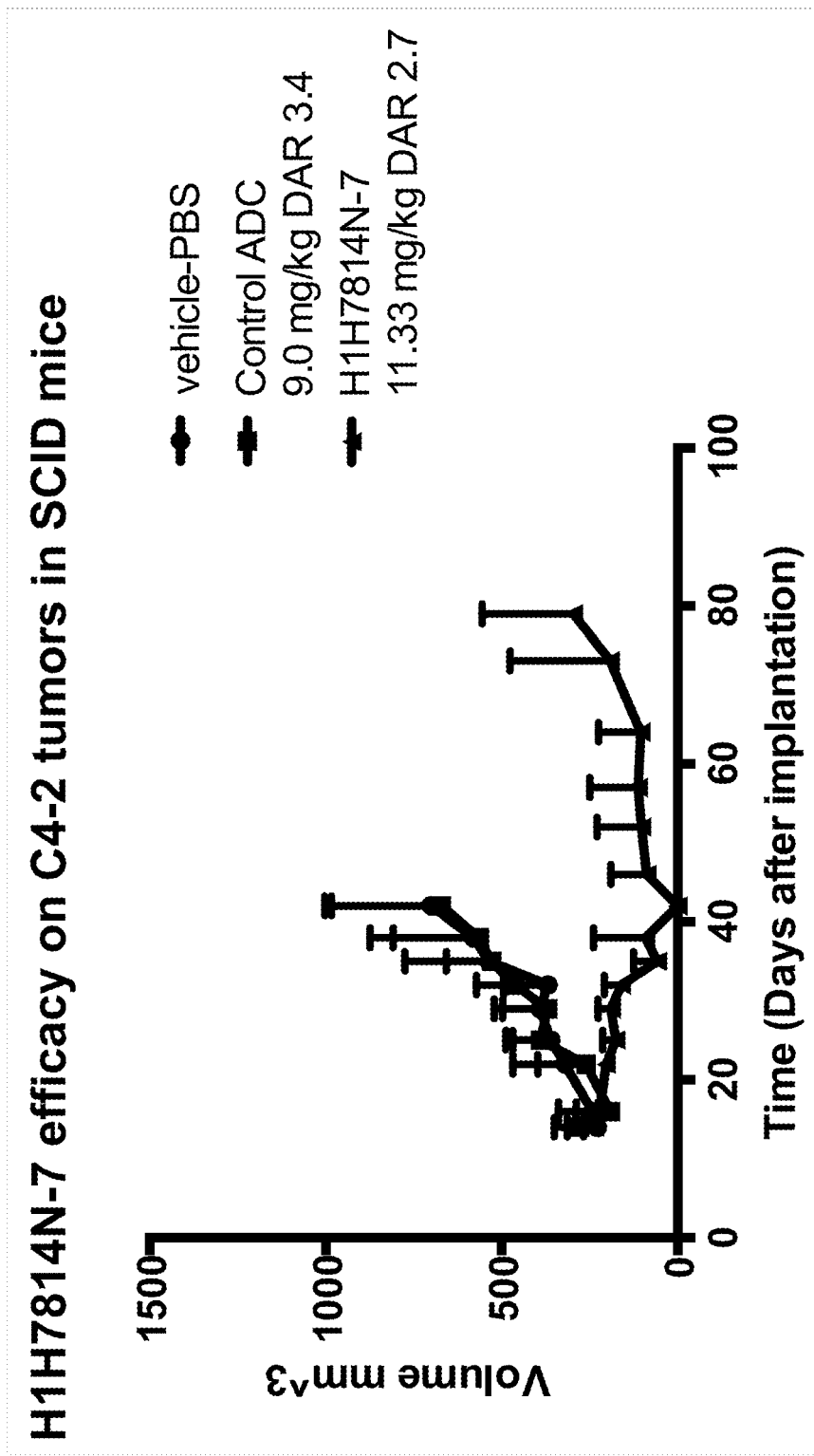
FIG. 3 shows efficacy of H1H7814N-7 in a STEAP2 positive prostate cancer xenograft model (SCID mice implanted with C4-2 cells) at a dose of 150 µg/kg H1H7814N-7 administered on day 17 after implantation.

In a further study, H1H7841N-7 (DAR 2.7) and the control antibody were dosed at µg/kg drug equivalents based on ADC drug:antibody ratios ("DAR"). The dose was 150 µg/kg administered on day 17 after implantation (FIG. 3). H1H7841N-7 potently inhibited tumor growth at the 150 µg/kg dose showing tumor regression up to 42 days post implantation and 25 days after injection. At this point, tumor growth began to rebound. Tumor growth with the control antibody at this dose was no different from vehicle control.

Figure 4:
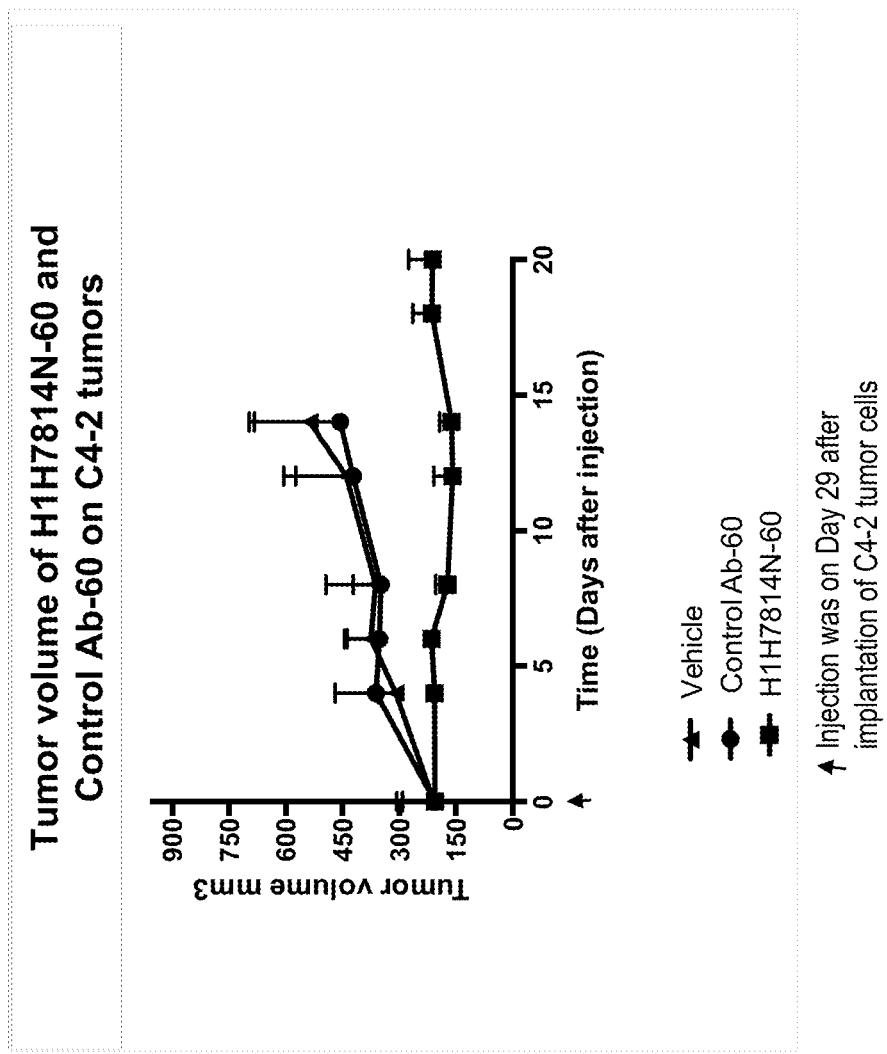
FIG. 4 shows efficacy of H1H7814N-60 in a STEAP2 positive prostate cancer xenograft model (SCID mice implanted with C4-2 cells) at a dose of 2.5 mg/kg (DAR 3.6 TV) H1H7814N-60 administered on day 29 after implantation.

B. In analogous studies, Male SCID mice (Taconic, Hudson N.Y.) were implanted with C4-2 cells endogenously expressing STEAP2. An exemplary anti-STEAP2 (H1H7814N) antibody conjugated to Compound 60 was examined for efficacy in C4-2 tumor regression. Mice received a single dose of anti-STEAP2 ADC, isotype control ADC (binds to irrelevant antigen), or vehicle (PBS) at 2.5 mg/kg on day 29 after implantation. Tumor volume and body weight was recorded at day 0 (day of injection), and at day 4, 6, 8, 12, 14, and day 20 following the injection. As summarized in FIG. 4, H1H7814N-60 (DAR 3.6) potently inhibited tumor growth at the dose tested, showing tumor regression up to 20 days after injection (49 days post implantation). Percent change in body weight for the test ADC was no more than −2.01% through day 14 (following injection of H1H7814N-60) compared to mice treated with the Control Ab-ADC for which body weight percent change was observed from −4.02% to −11.55% through day 14.

Example 8: Generation of Anti-CD3 Antibodies

Anti-CD3 antibodies were obtained by immunizing an engineered mouse comprising DNA encoding human Immunoglobulin heavy and kappa light chain variable regions with cells expressing CD3 or with DNA encoding CD3. The antibody immune response was monitored by a CD3-specific immunoassay. When a desired immune response was achieved, splenocytes were harvested and fused with mouse myeloma cells to preserve their viability and form hybridoma cell lines. The hybridoma cell lines were screened and selected to identify cell lines that produce CD3-specific antibodies. Using this technique several anti-CD3 chimeric antibodies (i.e., antibodies possessing human variable domains and mouse constant domains) were obtained. In addition, several fully human anti-CD3 antibodies were isolated directly from antigen-positive B cells without fusion to myeloma cells, as described in US 2007/0280945A1.

Certain biological properties of the exemplary anti-CD3 antibodies generated in accordance with the methods of this Example are described in detail in the Examples herein.

Example 9: Heavy and Light Chain Variable Region Amino Acid and Nucleic Acid Sequences Table 9 sets forth the amino acid sequence identifiers of the heavy and light chain variable regions and CDRs of selected anti-CD3 antibodies of the invention. The corresponding nucleic acid sequence identifiers are set forth in Table 10. Methods of making the anti-CD3 antibodies disclosed herein can also be found in US publication 2014/0088295 published Mar. 27, 2014.

TABLE 9

| Antibody Designation | Amino Acid Sequence Identifiers SEQ ID NOs: | | | | | | | |
|---|---|---|---|---|---|---|---|---|
| | HCVR | HCDR1 | HCDR2 | HCDR3 | LCVR | LCDR11 | LCDR2 | LCDR3 |
| H1H2712N | 402 | 404 | 406 | 408 | 410 | 412 | 414 | 416 |
| H1M2692N | 418 | 420 | 422 | 424 | 426 | 428 | 430 | 432 |
| H1M3542N | 434 | 436 | 438 | 440 | 442 | 444 | 446 | 448 |
| H1M3544N | 450 | 452 | 454 | 456 | 458 | 460 | 462 | 464 |
| H1M3549N | 466 | 468 | 470 | 472 | 474 | 476 | 478 | 480 |
| H1M3613N | 482 | 484 | 486 | 488 | 490 | 492 | 494 | 496 |
| H2M2689N | 498 | 500 | 502 | 504 | 506 | 508 | 510 | 512 |
| H2M2690N | 514 | 516 | 518 | 520 | 522 | 524 | 526 | 528 |
| H2M2691N | 530 | 532 | 534 | 536 | 538 | 540 | 542 | 544 |
| H2M2704N | 546 | 548 | 550 | 552 | 554 | 556 | 558 | 560 |
| H2M2705N | 562 | 564 | 566 | 568 | 570 | 572 | 574 | 576 |
| H2M2706N | 578 | 580 | 582 | 584 | 586 | 588 | 590 | 592 |
| H2M2707N | 594 | 596 | 598 | 600 | 602 | 604 | 606 | 608 |
| H2M2708N | 610 | 612 | 614 | 616 | 618 | 620 | 622 | 624 |
| H2M2709N | 626 | 628 | 630 | 632 | 634 | 636 | 638 | 640 |
| H2M2710N | 642 | 644 | 646 | 648 | 650 | 652 | 654 | 656 |
| H2M2711N | 658 | 660 | 662 | 664 | 666 | 668 | 670 | 672 |
| H2M2774N | 674 | 676 | 678 | 680 | 682 | 684 | 686 | 688 |
| H2M2775N | 690 | 692 | 694 | 696 | 698 | 700 | 702 | 704 |
| H2M2776N | 706 | 708 | 710 | 712 | 714 | 716 | 718 | 720 |
| H2M2777N | 722 | 724 | 726 | 728 | 730 | 732 | 734 | 736 |
| H2M2778N | 738 | 740 | 742 | 744 | 746 | 748 | 750 | 752 |
| H2M2779N | 754 | 756 | 758 | 760 | 762 | 764 | 766 | 768 |
| H2M2789N | 770 | 772 | 774 | 776 | 778 | 780 | 782 | 784 |
| H2M2862N | 786 | 788 | 790 | 792 | 794 | 796 | 798 | 800 |
| H2M2885N | 802 | 804 | 806 | 808 | 810 | 812 | 814 | 816 |
| H2M2886N | 818 | 820 | 822 | 824 | 826 | 828 | 830 | 832 |
| H2M3540N | 834 | 836 | 838 | 840 | 842 | 844 | 846 | 848 |
| H2M3541N | 850 | 852 | 854 | 856 | 858 | 860 | 862 | 864 |
| H2M3543N | 866 | 868 | 870 | 872 | 874 | 876 | 878 | 880 |
| H2M3547N | 882 | 884 | 886 | 888 | 890 | 892 | 894 | 896 |
| H2M3548N | 898 | 900 | 902 | 904 | 906 | 908 | 910 | 912 |
| H2M3563N | 914 | 916 | 918 | 920 | 922 | 924 | 926 | 928 |
| H1H5751P | 930 | 932 | 934 | 936 | 938 | 940 | 942 | 944 |
| H1H5752P | 946 | 948 | 950 | 952 | 954 | 956 | 958 | 960 |
| H1H5753B | 962 | 964 | 966 | 968 | 970 | 972 | 974 | 976 |
| H1H5754B | 978 | 980 | 982 | 984 | 986 | 988 | 990 | 992 |
| H1H5755B | 994 | 996 | 998 | 1000 | 1002 | 1004 | 1006 | 1008 |
| H1H5756B | 1010 | 1012 | 1014 | 1016 | 1018 | 1020 | 1022 | 1024 |
| H1H5757B | 1026 | 1028 | 1030 | 1032 | 1034 | 1036 | 1038 | 1040 |
| H1H5758B | 1042 | 1044 | 1046 | 1048 | 1050 | 1052 | 1054 | 1056 |
| H1H5761P | 1058 | 1060 | 1062 | 1064 | 1066 | 1068 | 1070 | 1072 |
| H1H5763P | 1074 | 1076 | 1078 | 1080 | 1082 | 1084 | 1086 | 1088 |
| H1H5764P | 1090 | 1092 | 1094 | 1096 | 1098 | 1100 | 1102 | 1104 |
| H1H5769P | 1106 | 1108 | 1110 | 1112 | 1114 | 1116 | 1118 | 1120 |
| H1H5771P | 1122 | 1124 | 1126 | 1128 | 1130 | 1132 | 1134 | 1136 |
| H1H5772P | 1138 | 1140 | 1142 | 1144 | 1146 | 1148 | 1150 | 1152 |
| H1H5777P | 1154 | 1156 | 1158 | 1160 | 1162 | 1164 | 1166 | 1168 |
| H1H5778P | 1170 | 1172 | 1174 | 1176 | 1178 | 1180 | 1182 | 1184 |
| H1H5780P | 1186 | 1188 | 1190 | 1192 | 1194 | 1196 | 1198 | 1200 |
| H1H5781P | 1202 | 1204 | 1206 | 1208 | 1210 | 1212 | 1214 | 1216 |
| H1H5782P | 1218 | 1220 | 1222 | 1224 | 1226 | 1228 | 1230 | 1232 |
| H1H5785B | 1234 | 1236 | 1238 | 1240 | 1242 | 1244 | 1246 | 1248 |
| H1H5786B | 1250 | 1252 | 1254 | 1256 | 1258 | 1260 | 1262 | 1264 |
| H1H5788P | 1266 | 1268 | 1270 | 1272 | 1274 | 1276 | 1278 | 1280 |
| H1H5790B | 1282 | 1284 | 1286 | 1288 | 1290 | 1292 | 1294 | 1296 |
| H1H5791B | 1298 | 1300 | 1302 | 1304 | 1306 | 1308 | 1310 | 1312 |
| H1H5792B | 1314 | 1316 | 1318 | 1320 | 1322 | 1324 | 1326 | 1328 |
| H1H5793B | 1330 | 1332 | 1334 | 1336 | 1338 | 1340 | 1342 | 1344 |
| H1H5795B | 1346 | 1348 | 1350 | 1352 | 1354 | 1356 | 1358 | 1360 |
| H1H5796B | 1362 | 1364 | 1366 | 1368 | 1370 | 1372 | 1374 | 1376 |
| H1H5797B | 1378 | 1380 | 1382 | 1384 | 1386 | 1388 | 1390 | 1392 |
| H1H5798B | 1394 | 1396 | 1398 | 1400 | 1402 | 1404 | 1406 | 1408 |
| H1H5799P | 1410 | 1412 | 1414 | 1416 | 1418 | 1420 | 1422 | 1424 |
| H1H5801B | 1426 | 1428 | 1430 | 1432 | 1434 | 1436 | 1438 | 1440 |
| H1H7194B | 1442 | 1444 | 1446 | 1448 | 1634 | 1636 | 1638 | 1640 |
| H1H7195B | 1450 | 1452 | 1454 | 1456 | 1634 | 1636 | 1638 | 1640 |
| H1H7196B | 1458 | 1460 | 1462 | 1464 | 1634 | 1636 | 1638 | 1640 |
| H1H7198B | 1466 | 1468 | 1470 | 1472 | 1634 | 1636 | 1638 | 1640 |
| H1H7203B | 1474 | 1476 | 1478 | 1480 | 1634 | 1636 | 1638 | 1640 |
| H1H7204B | 1482 | 1484 | 1486 | 1488 | 1634 | 1636 | 1638 | 1640 |
| H1H7208B | 1490 | 1492 | 1494 | 1496 | 1634 | 1636 | 1638 | 1640 |
| H1H7211B | 1498 | 1500 | 1502 | 1504 | 1634 | 1636 | 1638 | 1640 |
| H1H7221B | 1506 | 1508 | 1510 | 1512 | 1634 | 1636 | 1638 | 1640 |

TABLE 9-continued

Amino Acid Sequence Identifiers

| Antibody Designation | SEQ ID NOs: | | | | | | | |
|---|---|---|---|---|---|---|---|---|
| | HCVR | HCDR1 | HCDR2 | HCDR3 | LCVR | LCDR11 | LCDR2 | LCDR3 |
| H1H7223B | 1514 | 1516 | 1518 | 1520 | 1634 | 1636 | 1638 | 1640 |
| H1H7226B | 1522 | 1524 | 1526 | 1528 | 1634 | 1636 | 1638 | 1640 |
| H1H7232B | 1530 | 1532 | 1534 | 1536 | 1634 | 1636 | 1638 | 1640 |
| H1H7233B | 1538 | 1540 | 1542 | 1544 | 1634 | 1636 | 1638 | 1640 |
| H1H7241B | 1546 | 1548 | 1550 | 1552 | 1634 | 1636 | 1638 | 1640 |
| H1H7242B | 1554 | 1556 | 1558 | 1560 | 1634 | 1636 | 1638 | 1640 |
| H1H7250B | 1562 | 1564 | 1566 | 1568 | 1634 | 1636 | 1638 | 1640 |
| H1H7251B | 1570 | 1572 | 1574 | 1576 | 1634 | 1636 | 1638 | 1640 |
| H1H7254B | 1578 | 1580 | 1582 | 1584 | 1634 | 1636 | 1638 | 1640 |
| H1H7258B | 1586 | 1588 | 1590 | 1592 | 1634 | 1636 | 1638 | 1640 |
| H1H7269B | 1594 | 1596 | 1598 | 1600 | 1634 | 1636 | 1638 | 1640 |
| H1H7279B | 1602 | 1604 | 1606 | 1608 | 1634 | 1636 | 1638 | 1640 |
| H1xH7221G | 1610 | 1612 | 1614 | 1616 | 1634 | 1636 | 1638 | 1640 |
| H1xH7221G3 | 1618 | 1620 | 1622 | 1624 | 1634 | 1636 | 1638 | 1640 |
| H1xH7221G5 | 1626 | 1628 | 1630 | 1632 | 1634 | 1636 | 1638 | 1640 |

TABLE 10

Nucleic Acid Sequence Identifiers

| Antibody Designation | SEQ ID NOs: | | | | | | | |
|---|---|---|---|---|---|---|---|---|
| | HCVR | HCDR1 | HCDR2 | HCDR3 | LCVR | LCDR1 | LCDR2 | LCDR3 |
| H1H2712N | 401 | 403 | 405 | 407 | 409 | 411 | 413 | 415 |
| H1M2692N | 417 | 419 | 421 | 423 | 425 | 427 | 429 | 431 |
| H1M3542N | 433 | 435 | 437 | 439 | 441 | 443 | 445 | 447 |
| H1M3544N | 449 | 451 | 453 | 455 | 457 | 459 | 461 | 463 |
| H1M3549N | 465 | 467 | 469 | 471 | 473 | 475 | 477 | 479 |
| H1M3613N | 481 | 483 | 485 | 487 | 489 | 491 | 493 | 495 |
| H2M2689N | 497 | 499 | 501 | 503 | 505 | 507 | 509 | 511 |
| H2M2690N | 513 | 515 | 517 | 519 | 521 | 523 | 525 | 527 |
| H2M2691N | 529 | 531 | 533 | 535 | 537 | 539 | 541 | 543 |
| H2M2704N | 545 | 547 | 549 | 551 | 553 | 555 | 557 | 559 |
| H2M2705N | 561 | 563 | 565 | 567 | 569 | 571 | 573 | 575 |
| H2M2706N | 577 | 579 | 581 | 583 | 585 | 587 | 589 | 591 |
| H2M2707N | 593 | 595 | 597 | 599 | 601 | 603 | 605 | 607 |
| H2M2708N | 609 | 611 | 613 | 615 | 617 | 619 | 621 | 623 |
| H2M2709N | 625 | 627 | 629 | 631 | 633 | 635 | 637 | 639 |
| H2M2710N | 641 | 643 | 645 | 647 | 649 | 651 | 653 | 655 |
| H2M2711N | 657 | 659 | 661 | 663 | 665 | 667 | 669 | 671 |
| H2M2774N | 673 | 675 | 677 | 679 | 681 | 683 | 685 | 687 |
| H2M2775N | 689 | 691 | 693 | 695 | 697 | 699 | 701 | 703 |
| H2M2776N | 705 | 707 | 709 | 711 | 713 | 715 | 717 | 719 |
| H2M2777N | 721 | 723 | 725 | 727 | 729 | 731 | 733 | 735 |
| H2M2778N | 737 | 739 | 741 | 743 | 745 | 747 | 749 | 751 |
| H2M2779N | 753 | 755 | 757 | 759 | 761 | 763 | 765 | 767 |
| H2M2789N | 769 | 771 | 773 | 775 | 777 | 779 | 781 | 783 |
| H2M2862N | 785 | 787 | 789 | 791 | 793 | 795 | 797 | 799 |
| H2M2885N | 801 | 803 | 805 | 807 | 809 | 811 | 813 | 815 |
| H2M2886N | 817 | 819 | 821 | 823 | 825 | 827 | 829 | 831 |
| H2M3540N | 833 | 835 | 837 | 839 | 841 | 843 | 845 | 847 |
| H2M3541N | 849 | 851 | 853 | 855 | 857 | 859 | 861 | 863 |
| H2M3543N | 865 | 867 | 869 | 871 | 873 | 875 | 877 | 879 |
| H2M3547N | 881 | 883 | 885 | 887 | 889 | 891 | 893 | 895 |
| H2M3548N | 897 | 899 | 901 | 903 | 905 | 907 | 909 | 911 |
| H2M3563N | 913 | 915 | 917 | 919 | 921 | 923 | 925 | 927 |
| H1H5751P | 929 | 931 | 933 | 935 | 937 | 939 | 941 | 943 |
| H1H5752P | 945 | 947 | 949 | 951 | 953 | 955 | 957 | 959 |
| H1H5753B | 961 | 963 | 965 | 967 | 969 | 971 | 973 | 975 |
| H1H5754B | 977 | 979 | 981 | 983 | 985 | 987 | 989 | 991 |
| H1H5755B | 993 | 995 | 997 | 999 | 1001 | 1003 | 1005 | 1007 |
| H1H5756B | 1009 | 1011 | 1013 | 1015 | 1017 | 1019 | 1021 | 1023 |
| H1H5757B | 1025 | 1027 | 1029 | 1031 | 1033 | 1035 | 1037 | 1039 |
| H1H5758B | 1041 | 1043 | 1045 | 1047 | 1049 | 1051 | 1053 | 1055 |
| H1H5761P | 1057 | 1059 | 1061 | 1063 | 1065 | 1067 | 1069 | 1071 |
| H1H5763P | 1073 | 1075 | 1077 | 1079 | 1081 | 1083 | 1085 | 1087 |
| H1H5764P | 1089 | 1091 | 1093 | 1095 | 1097 | 1099 | 1101 | 1103 |
| H1H5769P | 1105 | 1107 | 1109 | 1111 | 1113 | 1115 | 1117 | 1119 |
| H1H5771P | 1121 | 1123 | 1125 | 1127 | 1129 | 1131 | 1133 | 1135 |
| H1H5772P | 1137 | 1139 | 1141 | 1143 | 1145 | 1147 | 1149 | 1151 |

TABLE 10-continued

Nucleic Acid Sequence Identifiers

| Antibody Designation | SEQ ID NOs: | | | | | | | |
|---|---|---|---|---|---|---|---|---|
| | HCVR | HCDR1 | HCDR2 | HCDR3 | LCVR | LCDR1 | LCDR2 | LCDR3 |
| H1H5777P | 1153 | 1155 | 1157 | 1159 | 1161 | 1163 | 1165 | 1167 |
| H1H5778P | 1169 | 1171 | 1173 | 1175 | 1177 | 1179 | 1181 | 1183 |
| H1H5780P | 1185 | 1187 | 1189 | 1191 | 1193 | 1195 | 1197 | 1199 |
| H1H5781P | 1201 | 1203 | 1205 | 1207 | 1209 | 1211 | 1213 | 1215 |
| H1H5782P | 1217 | 1219 | 1221 | 1223 | 1225 | 1227 | 1229 | 1231 |
| H1H5785B | 1233 | 1235 | 1237 | 1239 | 1241 | 1243 | 1245 | 1247 |
| H1H5786B | 1249 | 1251 | 1253 | 1255 | 1257 | 1259 | 1261 | 1263 |
| H1H5788P | 1265 | 1267 | 1269 | 1271 | 1273 | 1275 | 1277 | 1279 |
| H1H5790B | 1281 | 1283 | 1285 | 1287 | 1289 | 1291 | 1293 | 1295 |
| H1H5791B | 1297 | 1299 | 1301 | 1303 | 1305 | 1307 | 1309 | 1311 |
| H1H5792B | 1313 | 1315 | 1317 | 1319 | 1321 | 1323 | 1325 | 1327 |
| H1H5793B | 1329 | 1331 | 1333 | 1335 | 1337 | 1339 | 1341 | 1343 |
| H1H5795B | 1345 | 1347 | 1349 | 1351 | 1353 | 1355 | 1357 | 1359 |
| H1H5796B | 1361 | 1363 | 1365 | 1367 | 1369 | 1371 | 1373 | 1375 |
| H1H5797B | 1377 | 1379 | 1381 | 1383 | 1385 | 1387 | 1389 | 1391 |
| H1H5798B | 1393 | 1395 | 1397 | 1399 | 1401 | 1403 | 1405 | 1407 |
| H1H5799P | 1409 | 1411 | 1413 | 1415 | 1417 | 1419 | 1421 | 1423 |
| H1H5801B | 1425 | 1427 | 1429 | 1431 | 1433 | 1435 | 1437 | 1439 |
| H1H7194B | 1441 | 1443 | 1445 | 1447 | 1633 | 1635 | 1637 | 1639 |
| H1H7195B | 1449 | 1451 | 1453 | 1455 | 1633 | 1635 | 1637 | 1639 |
| H1H7196B | 1457 | 1459 | 1461 | 1463 | 1633 | 1635 | 1637 | 1639 |
| H1H7198B | 1465 | 1467 | 1469 | 1471 | 1633 | 1635 | 1637 | 1639 |
| H1H7203B | 1473 | 1475 | 1477 | 1479 | 1633 | 1635 | 1637 | 1639 |
| H1H7204B | 1481 | 1483 | 1485 | 1487 | 1633 | 1635 | 1637 | 1639 |
| H1H7208B | 1489 | 1491 | 1493 | 1495 | 1633 | 1635 | 1637 | 1639 |
| H1H7211B | 1497 | 1499 | 1501 | 1503 | 1633 | 1635 | 1637 | 1639 |
| H1H7221B | 1505 | 1507 | 1509 | 1511 | 1633 | 1635 | 1637 | 1639 |
| H1H7223B | 1513 | 1515 | 1517 | 1519 | 1633 | 1635 | 1637 | 1639 |
| H1H7226B | 1521 | 1523 | 1525 | 1527 | 1633 | 1635 | 1637 | 1639 |
| H1H7232B | 1529 | 1531 | 1533 | 1535 | 1633 | 1635 | 1637 | 1639 |
| H1H7233B | 1537 | 1539 | 1541 | 1543 | 1633 | 1635 | 1637 | 1639 |
| H1H7241B | 1545 | 1547 | 1549 | 1551 | 1633 | 1635 | 1637 | 1639 |
| H1H7242B | 1553 | 1555 | 1557 | 1559 | 1633 | 1635 | 1637 | 1639 |
| H1H7250B | 1561 | 1563 | 1565 | 1567 | 1633 | 1635 | 1637 | 1639 |
| H1H7251B | 1569 | 1571 | 1573 | 1575 | 1633 | 1635 | 1637 | 1639 |
| H1H7254B | 1577 | 1579 | 1581 | 1583 | 1633 | 1635 | 1637 | 1639 |
| H1H7258B | 1585 | 1587 | 1589 | 1591 | 1633 | 1635 | 1637 | 1639 |
| H1H7269B | 1593 | 1595 | 1597 | 1599 | 1633 | 1635 | 1637 | 1639 |
| H1H7279B | 1601 | 1603 | 1605 | 1607 | 1633 | 1635 | 1637 | 1639 |
| H1xH7221G | 1609 | 1611 | 1613 | 1615 | 1633 | 1635 | 1637 | 1639 |
| H1xH7221G3 | 1617 | 1619 | 1621 | 1623 | 1633 | 1635 | 1637 | 1639 |
| H1xH7221G5 | 1625 | 1627 | 1629 | 1631 | 1633 | 1635 | 1637 | 1639 |

Antibodies are typically referred to herein according to the following nomenclature: Fc prefix (e.g. "H1H," "H1M," "H2M," etc.), followed by a numerical identifier (e.g. "2712," "2692," etc., as shown in Table 1), followed by a "P," "N," or "B" suffix. Thus, according to this nomenclature, an antibody may be referred to herein as, e.g., "H1H2712N," "H1M2692N," "H2M2689N," etc. The H1H, H1M and H2M prefixes on the antibody designations used herein indicate the particular Fc region isotype of the antibody. For example, an "H1H" antibody has a human IgG1 Fc, an "H1M" antibody has a mouse IgG1 Fc, and an "H2M" antibody has a mouse IgG2 Fc, (all variable regions are fully human as denoted by the first 'H' in the antibody designation). As will be appreciated by a person of ordinary skill in the art, an antibody having a particular Fc isotype can be converted to an antibody with a different Fc isotype (e.g., an antibody with a mouse IgG1 Fc can be converted to an antibody with a human IgG4, etc.), but in any event, the variable domains (including the CDRs) ~which are indicated by the numerical identifiers shown in Table 1—will remain the same, and the binding properties are expected to be identical or substantially similar regardless of the nature of the Fc domain.

Tables 11 and 12 set out the amino acid sequence identifiers for heavy chain variable regions (Table 13) and light chain variable regions (Table 14), and their corresponding CDRs, of additional anti-CD3 HCVRs and LCVRs useful in anti-STEAP2×anti-CD3 bispecific antibodies of the invention.

TABLE 11

(Heavy Chain Variable Region Amino Acid Sequences)

| Heavy Chain Identifier | SEQ ID NOs | | | |
|---|---|---|---|---|
| | HCVR | HCDR1 | HCDR2 | HCDR3 |
| CD3-VH-AA | 1642 | 1644 | 1646 | 1648 |
| CD3-VH-B | 1658 | 1660 | 1662 | 1664 |
| CD3-VH-C | 1674 | 1676 | 1678 | 1680 |
| CD3-VH-D | 1690 | 1692 | 1694 | 1696 |
| CD3-VH-E | 1706 | 1708 | 1710 | 1712 |
| CD3-VH-F[#] | 1721 | 1722 | 1723 | 1724 |

TABLE 12

(Light Chain Variable Region Amino Acid Sequences)

| | SEQ ID NOs | | | |
|---|---|---|---|---|
| Light Chain Identifier | LCVR | LCDR1 | LCDR2 | LCDR3 |
| CD3-VL-AA | 1650 | 1652 | 1654 | 1656 |
| CD3-VL-B | 1666 | 1668 | 1670 | 1672 |
| CD3-VL-C | 1682 | 1684 | 1686 | 1688 |
| CD3-VL-D | 1698 | 1700 | 1702 | 1704 |
| CD3-VL-E | 1714 | 1716 | 1718 | 1720 |
| CD3-VL-F# | 1725 | 1726 | 1727 | 1728 |

The heavy and light chain variable regions of CD3-VH-F and CD3-VL-F were derived from the anti-CD3 antibody designated "L2K" as set forth in WO2004/106380.

In addition, Tables 13 and 14 set out the sequence identifiers for the nucleotide sequences encoding the heavy chain variable regions (Table 13) and light chain variable regions (Table 14), and their corresponding CDRs, of additional anti-CD3 HCVRs and LCVRs useful in anti-STEAP2×anti-CD3 bispecific antibodies of the invention.

TABLE 13

(Nucleotide Sequences Encoding Heavy Chain Variable Region Sequences)

| | SEQ ID NOs | | | |
|---|---|---|---|---|
| Heavy Chain Identifier | HCVR | HCDR1 | HCDR2 | HCDR3 |
| CD3-VH-AA | 1641 | 1643 | 1645 | 1647 |
| CD3-VH-B | 1657 | 1659 | 1661 | 1663 |
| CD3-VH-C | 1673 | 1675 | 1677 | 1679 |
| CD3-VH-D | 1689 | 1691 | 1693 | 1695 |
| CD3-VH-E | 1705 | 1707 | 1709 | 1711 |

TABLE 14

(Nucleotide Sequences Encoding Light Chain Variable Region Sequences)

| | SEQ ID NOs | | | |
|---|---|---|---|---|
| Light Chain Identifier | LCVR | LCDR1 | LCDR2 | LCDR3 |
| CD3-VL-AA | 1649 | 1651 | 1653 | 1655 |
| CD3-VL-B | 1665 | 1667 | 1669 | 1671 |
| CD3-VL-C | 1681 | 1683 | 1685 | 1687 |
| CD3-VL-D | 1697 | 1699 | 1701 | 1703 |
| CD3-VL-E | 1713 | 1715 | 1717 | 1719 |

Control Constructs Used in the Following Examples

Various control constructs (anti-CD3 antibodies) were included in the following experiments for comparative purposes: "OKT-3," a mouse monoclonal antibody against human T-cell surface antigens available from the American Type Culture Collection (ATCC) under catalog no. CRL-8001; and "SP34," a commercially available mouse monoclonal antibody obtained, e.g., from Biolegend, San Diego, Calif. (Cat. No. 302914) or BD Pharmagen, Cat. 55052, reactive against the epsilon chain of the T3 complex on human T lymphocyte cells.

Example 10: Generation of Additional Anti-CD3 Antibodies

The following procedures were aimed at identifying antibodies that specifically recognized CD3 (T cell co-receptor) as an antigen.

A pool of anti-CD3 antibodies were derived from a genetically modified mouse. Briefly, mice were immunized with a CD3 antigen and generated B cells that comprised a diversity of human VH rearrangements in order to express a diverse repertoire of high-affinity antigen-specific antibodies. Antibodies described in Tables 15-18 have the same light chain sequence of VK1-39JK5 (LCVR set forth in SEQ ID NO: 1890).

Generated antibodies were tested for affinity to human and cynomolgus monkey CD3 antigen in an in vitro binding assay, and e.g. one CD3 antibody: designated CD3-VH-P (HCVR set forth in SEQ ID NO: 1882) was identified, amongst a few others, that were found to bind to both human and cynomolgus CD3 having an $EC_{50}$ between 1 and 40 nM affinity, as determined in a FACS titration of Jurkat cells and cynomolgus T cells, respectively. See, e.g. FACS binding experiments outlined in Example 12 and in PCT/US2016/044732 filed Jul. 29, 2016.

The germline amino acid residues of CD3-VH-P were subsequently identified and an antibody designated "CD3-VH-G" was engineered to contain only germline frameworks. Other antibody derivatives were engineered by well-known molecular cloning techniques to replace amino acid residues in a stepwise manner based on differences between the germline sequence and the CD3-VH-P sequence. Each antibody derivative is given a "CD3-VH-G" number designation. See Table 15.

While CD3-VH-G and some other engineered antibodies retained their binding affinity as seen in the FACS assays, several anti-CD3 antibodies in a bispecific format bound to human or cynomolgus CD3 in vitro with weak to no measurable binding affinity, such greater than 100 nM EC50. Binding affinities, binding kinetics, and other biological properties to elucidate toxicity and pharmacokinetic (pK) profiles were subsequently investigated further as bispecific antibodies comprising the exemplary anti-CD3 antibodies, and were generated in accordance with the methods of this Example.

Example 11: Heavy and Light Chain Variable Regions (Amino Acid and Nucleic Acid Sequences of the CDRs)

Table 15 sets forth the amino acid sequence identifiers of the heavy chain variable regions and CDRs of selected anti-CD3 antibodies of the invention. The corresponding nucleic acid sequence identifiers are set forth in Table 16.

Amino acid and nucleic acid sequences were determined for each antibody heavy chain sequence. Each antibody heavy chain derived from the germline sequence (SEQ ID NO: 1910) was assigned a "G" number designation for consistent nomenclature. Table 15 sets forth the amino acid sequence identifiers of the heavy chain variable regions and CDRs of engineered anti-CD3 antibodies of the invention. The corresponding nucleic acid sequence identifiers are set forth in Table 16. The amino acid and nucleic acid sequence identifiers of the light chain variable region and CDRs are also identified below in Tables 17 and 18, respectively.

TABLE 15

Heavy Chain Amino Acid Sequence Identifiers

| Antibody CD3-VH Designation | SEQ ID NOs: | | | |
|---|---|---|---|---|
| | HCVR | CDR1 | CDR2 | CDR3 |
| CD3-VH-G | 1730 | 1732 | 1734 | 1736 |
| CD3-VH-G2 | 1738 | 1740 | 1742 | 1744 |
| CD3-VH-G3 | 1746 | 1748 | 1750 | 1752 |
| CD3-VH-G4 | 1754 | 1756 | 1758 | 1760 |
| CD3-VH-G5 | 1762 | 1764 | 1766 | 1768 |
| CD3-VH-G8 | 1770 | 1772 | 1774 | 1776 |
| CD3-VH-G9 | 1778 | 1780 | 1782 | 1784 |
| CD3-VH-G10 | 1786 | 1788 | 1790 | 1792 |
| CD3-VH-G11 | 1794 | 1796 | 1798 | 1800 |
| CD3-VH-G12 | 1802 | 1804 | 1806 | 1808 |
| CD3-VH-G13 | 1810 | 1812 | 1814 | 1816 |
| CD3-VH-G14 | 1818 | 1820 | 1822 | 1824 |
| CD3-VH-G15 | 1826 | 1828 | 1830 | 1832 |
| CD3-VH-G16 | 1834 | 1836 | 1838 | 1840 |
| CD3-VH-G17 | 1842 | 1844 | 1846 | 1848 |
| CD3-VH-G18 | 1850 | 1852 | 1854 | 1856 |
| CD3-VH-G19 | 1858 | 1860 | 1862 | 1864 |
| CD3-VH-G20 | 1866 | 1868 | 1870 | 1872 |
| CD3-VH-G21 | 1874 | 1876 | 1878 | 1880 |
| CD3-VH-P | 1882 | 1884 | 1886 | 1888 |

TABLE 16

Heavy Chain Nucleic Acid Sequence Identifiers

| Antibody CD3-VH Designation | SEQ ID NOs: | | | |
|---|---|---|---|---|
| | HCVR | CDR1 | CDR2 | CDR3 |
| CD3-VH-G | 1729 | 1731 | 1733 | 1735 |
| CD3-VH-G2 | 1737 | 1739 | 1741 | 1743 |
| CD3-VH-G3 | 1745 | 1747 | 1749 | 1751 |
| CD3-VH-G4 | 1753 | 1755 | 1757 | 1759 |
| CD3-VH-G5 | 1761 | 1763 | 1765 | 1767 |
| CD3-VH-G8 | 1769 | 1771 | 1773 | 1775 |
| CD3-VH-G9 | 1777 | 1779 | 1781 | 1783 |
| CD3-VH-G10 | 1785 | 1787 | 1789 | 1791 |
| CD3-VH-G11 | 1793 | 1795 | 1797 | 1799 |
| CD3-VH-G12 | 1801 | 1803 | 1805 | 1807 |
| CD3-VH-G13 | 1809 | 1811 | 1813 | 1815 |
| CD3-VH-G14 | 1817 | 1819 | 1821 | 1823 |
| CD3-VH-G15 | 1825 | 1827 | 1829 | 1831 |
| CD3-VH-G16 | 1833 | 1835 | 1837 | 1839 |
| CD3-VH-G17 | 1841 | 1843 | 1845 | 1847 |
| CD3-VH-G18 | 1849 | 1851 | 1853 | 1855 |
| CD3-VH-G19 | 1857 | 1859 | 1861 | 1863 |
| CD3-VH-G20 | 1865 | 1867 | 1869 | 1871 |
| CD3-VH-G21 | 1873 | 1875 | 1877 | 1879 |
| CD3-VH-P | 1881 | 1883 | 1885 | 1887 |

TABLE 17

Light Chain Amino Acid Sequence Identifiers

| Antibody Designation | SEQ ID NOs: | | | |
|---|---|---|---|---|
| | LCVR | CDR1 | CDR2 | CDR3 |
| VK1-39JK5 | 1890 | 1892 | 1894 | 1896 |

TABLE 18

Light Chain Nucleic Acid Sequence Identifiers

| Antibody Designation | SEQ ID NOs: | | | |
|---|---|---|---|---|
| | LCVR | CDR1 | CDR2 | CDR3 |
| VK1-39JK5 | 1889 | 1891 | 1893 | 1895 |

Control 1 antibody designated "CD3-L2K" was constructed based on a known anti-CD3 antibody (i.e., the anti-CD3 antibody "L2K" as set forth in WO2004/106380).

Isotype Control Antibody, referred to in the Examples herein, is an isotype matched (modified IgG4) antibody that interacts with an irrelevant antigen, i.e. FelD1 antigen.

Example 12: In Vitro and In Vivo Studies on Human Monoclonal Anti-CD3 Antibodies In vivo and in vitro studies on human monoclonal anti-CD3 antibodies were done as described in US publication 2014/0088295 published Mar. 27, 2014, and PCT/US2016/044732 filed Jul. 29, 2016, which are hereby incorporated by reference.

Some human monoclonal anti-CD3 antibodies of the present invention bind soluble heterodimeric CD3 protein, in either antibody-capture or antigen-capture formats, with high affinity. Soluble heterodimeric CD3 protein (hCD3-epsilon/hCD3-delta; SEQ ID NOs:1900/1901) was prepared with either a human Fc tag (hFcΔAdp/hFc; SEQ ID NOs: 1931/1932) or a mouse Fc tag (mFcΔAdp/mFc; SEQ ID NOs:1933/1934). Heterodimeric CD3 protein was purified using the method described in Davis et al. (US2010/0331527).

Some human monoclonal anti-CD3 antibodies of the invention bound human T-cells and induced T-cell proliferation. Some human monoclonal anti-CD3 antibodies of the invention bound CD2+CD4+ monkey T-cells and induced their proliferation. Some human monoclonal anti-CD3 antibodies supported redirected T-cell mediated killing via Fc/FcR interaction in a calcein based U937 killing assay. The observed killing, believed to be dependent on the antibody's Fc engagement with the Fc Receptor on U937 cells leading to clustering of CD3 on adjacent T-cells, was squelched by addition of non-specific human IgG (data not shown).

Example 13: In Vitro Studies on Human STEAP2×CD3 Bispecific Antibodies

FACS Binding Titration on Jurkat Cells, PC3_STEAP2/1 Cells and cynomolgus T Cells: Flow cytometric analysis was utilized to determine binding of STEAP2×CD3 bispecific antibodies to Jurkat, PC3_STEAP2/1 chimeric and cynomolgus T cells, followed by detection with a phycoerythrin (PE)-labeled anti-human IgG antibody. Briefly, 2×105 cells/well were incubated for 30 minutes at 4° C. with a serial dilution of STEAP2×CD3 bispecific antibodies or control antibody (a human IgG1 antibody that binds a feline antigen with no cross-reactivity to STEAP2 or human or cynomolgus CD3) ranging from 66.6 nM to 0.001 nM. After incubation, the cells were washed twice with cold PBS containing 1% filtered FBS and a PE-conjugated anti-human secondary antibody was added to the cells and incubated for an additional 30 minutes. Wells containing no antibody or secondary antibody only were used as a control. After incubation, cells were washed, re-suspended in 200 μL cold PBS containing 1% filtered FBS and analyzed by flow cytometry on a BD FACS Canto II.

TABLE 19

FACS Binding of selected STEAP2xCD3 Bispecific Antibodies to Jurkat, PC3_STEAP2/1 and cynomolgus T cells

| Bispecific Antibody Designation | FACS Jurkat EC50 [M] | FACS PC3_STEAP2/1 EC50 [M] | Cynomolgus T cells EC50 [M] |
|---|---|---|---|
| BSSTEAP2/CD3-0010 | 1.36E−08 | No Binding | Very Weak |
| BSSTEAP2/CD3-004 | 6.88E−10 | 7.91E−08 | 1.99E−09 |
| BSSTEAP2/CD3-0011 | 8.63E−09 | No Binding | No Binding |
| BSSTEAP2/CD3-005 | 1.41E−08 | 3.18E−08 | No Binding |
| BSSTEAP2/CD3-001 | 7.19E−09 | 3.44E−09 | 7.27E−09 |
| BSSTEAP2/CD3-006 | 3.98E−09 | 1.22E−08 | 7.99E−09 |
| BSSTEAP2/CD3-007 | 6.15E−10 | 5.37E−09 | 1.73E−08 |
| BSSTEAP2/CD3-008 | 1.52E−09 | 6.88E−08 | 1.66E−08 |
| BSSTEAP2/CD3-009 | 4.14E−09 | 4.21E−08 | No Binding |

Figure 5:
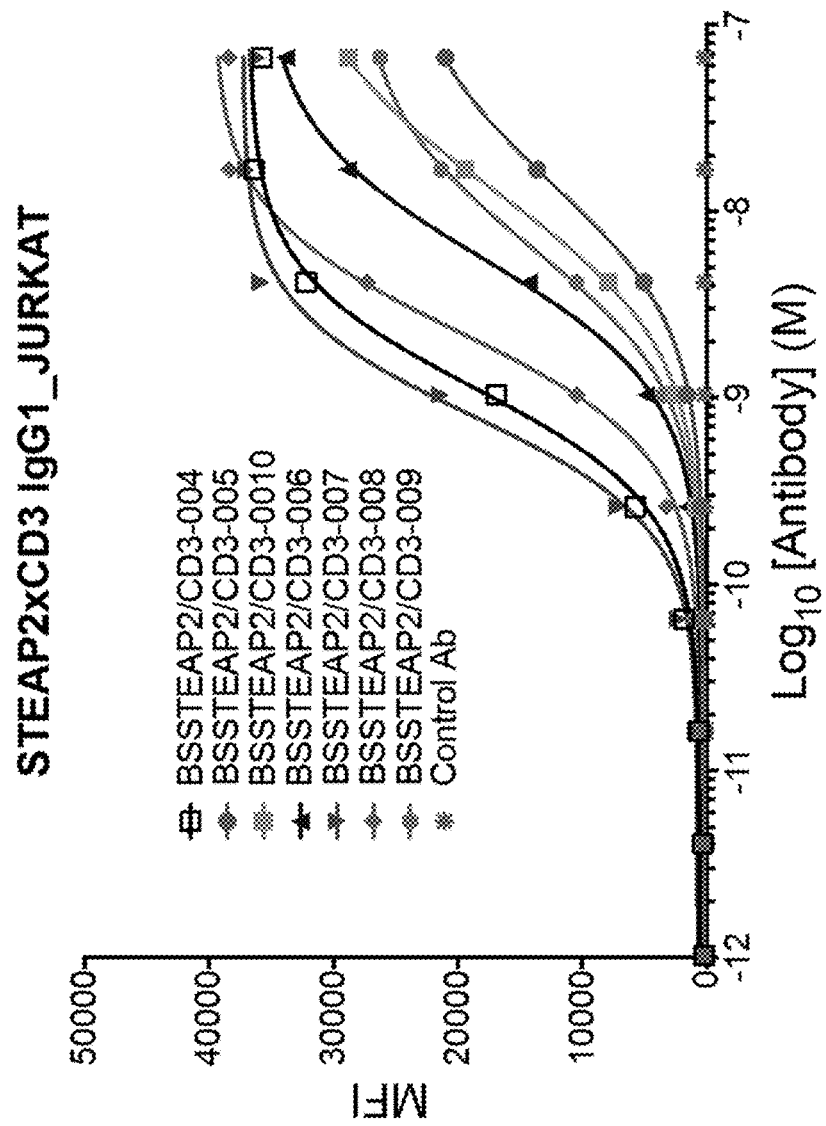
FIG. 5 shows the binding of STEAP2×CD3 bispecific antibodies to Jurkat cells.
Figure 6:
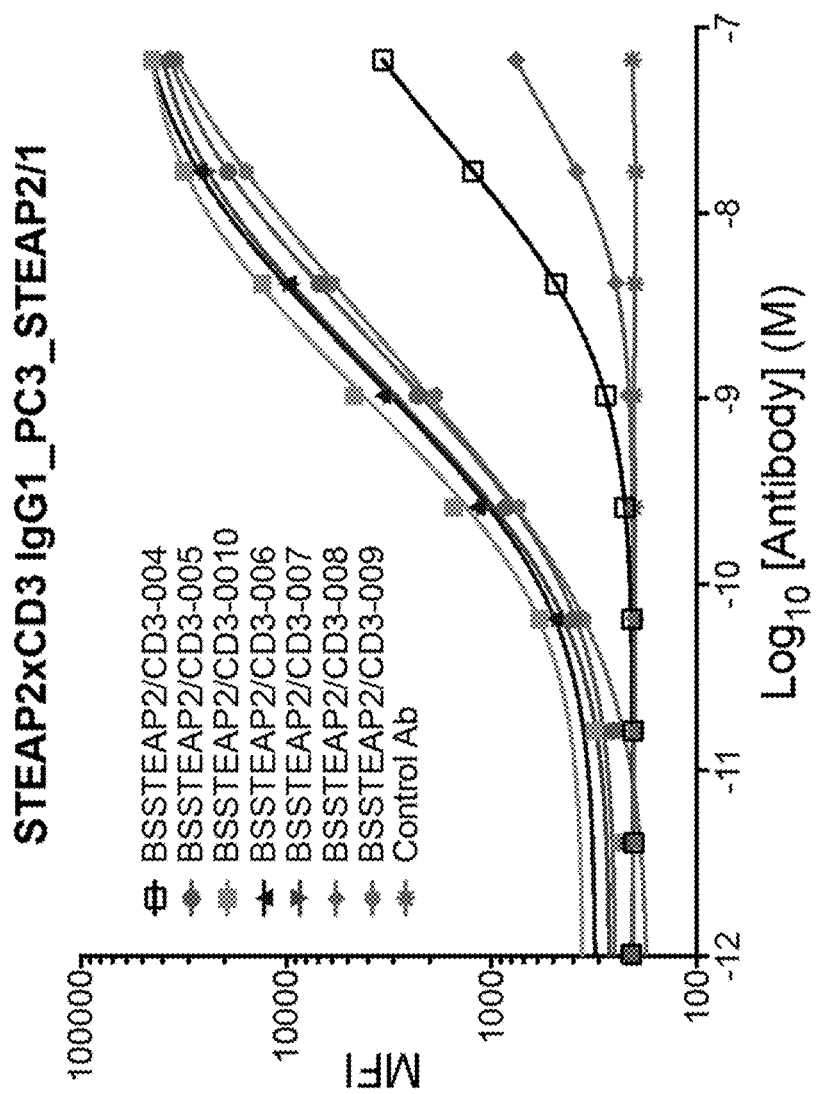
FIG. 6 shows the binding of STEAP2×CD3 bispecific antibodies to a human prostate cancer cell line (PC3) engineered to express a STEAP2/1 chimeric construct.

Jurkat cells are derived from a T cell lymphoblastic cell line that expresses human CD3. All bispecific antibodies tested (Table 19 and FIG. 5) bound to Jurkat cells with EC50 ranging from 1.41E-08 M to 6.15E-10 M. PC3 cells, a human prostate cancer cell line, was engineered to express a STEAP2/1 chimeric construct. Several bispecific antibodies bound to PC3_STEAP2/1 cells, with EC50 ranging from 7.91E-08 M to 3.44E-09 M (Table 19 and FIG. 6).

Figure 7:
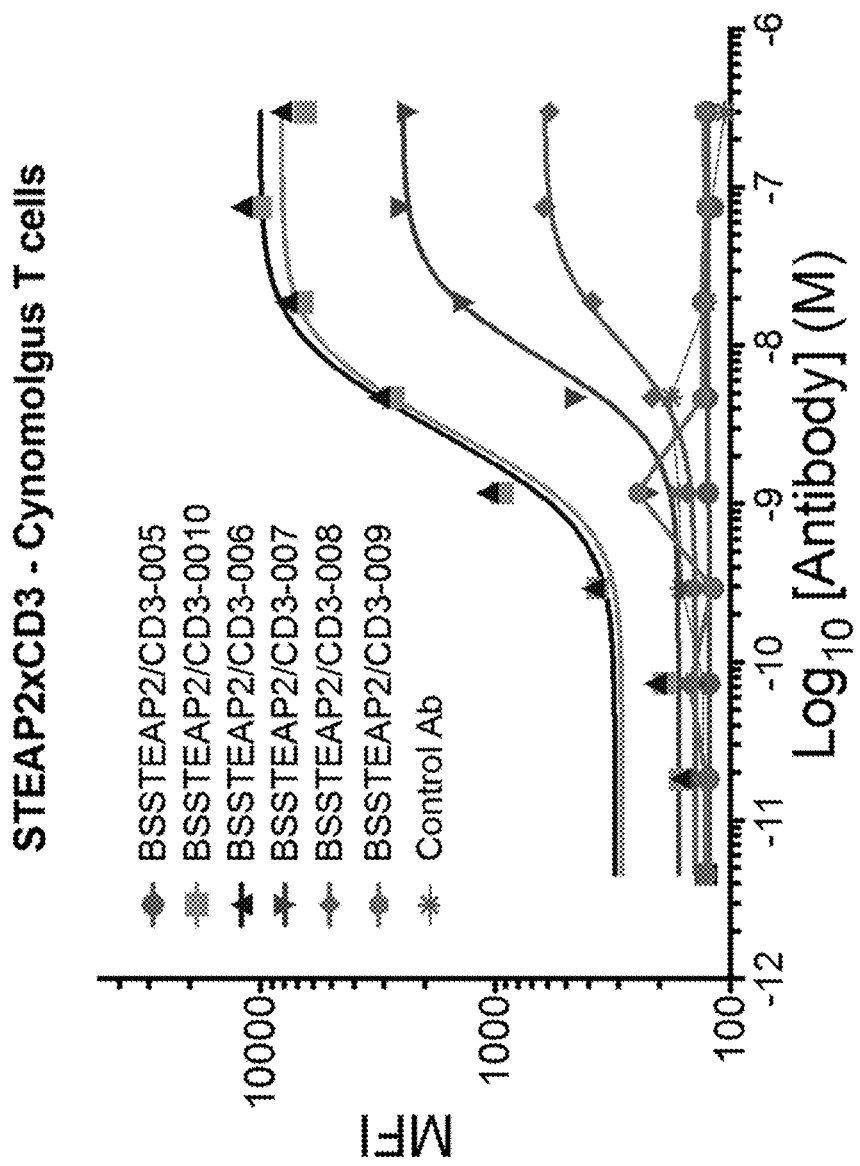
FIGS. 7 and 8 show the binding of STEAP2×CD3 bispecific antibodies to Cynomolgous T cells.
Figure 8:
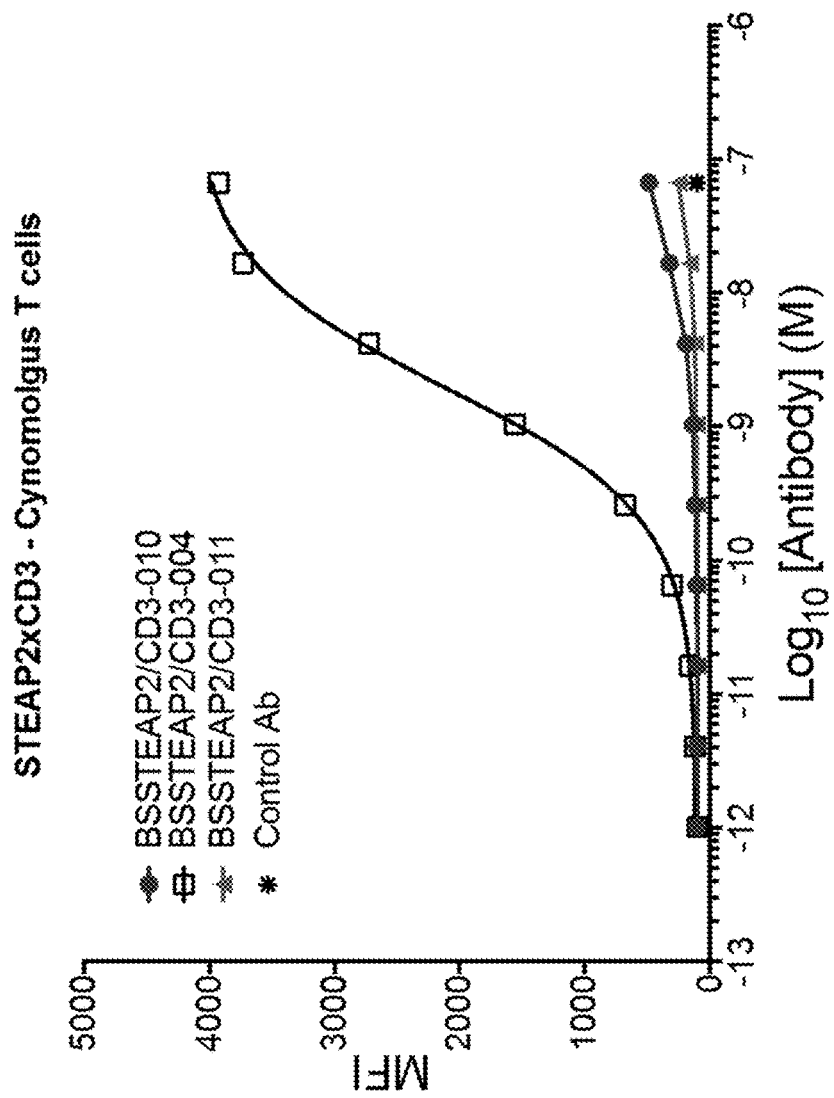

Binding of STEAP2×CD3 bispecific antibodies to the surface of purified Cynomolgus T cells was also tested. Several bispecific antibodies bound EC50 ranging from 1.73E-08 M to 7.27E-09 M. Control antibodies did not bind to either cell line. See Table 19 and FIGS. 7 and 8.

T Cell Proliferation Assay:

Thawed human or freshly isolated monkey PBMCs (50,000 cells/well) were incubated with 3-fold (human, concentration range: 5E-10M to 2.82E-15M; cynomolgus, concentration range: 1E-09M to 4.57E-13M) serial dilutions of STEAP2×CD3 bispecifics or isotype control in complete medium (RPMI supplemented with 10% FBS, 100 U/mL penicillin, 100 µg/mL streptomycin, 292 µg/mL L-glutamine) and a fixed concentration (human: 200 ng/mL, cyno: 500 ng/mL) of a commercial anti-CD28 antibody (Biolegend, Catalog #302914) in white flat bottom 96-well plates for 72 hours at 37° C. Isolated monkey PBMCs were from two donors (identified as mk8781M or mk9381M). Following incubation, CellTiter Glo® (Promega, Cat #7573) was added and luminescence, as readout for cell viability, was measured using a VICTOR X5 multi-label plate reader. Cell titer was calculated by dividing the luminescence of stimulated cells by the baseline luminescence of unstimulated cells.

Figure 9:
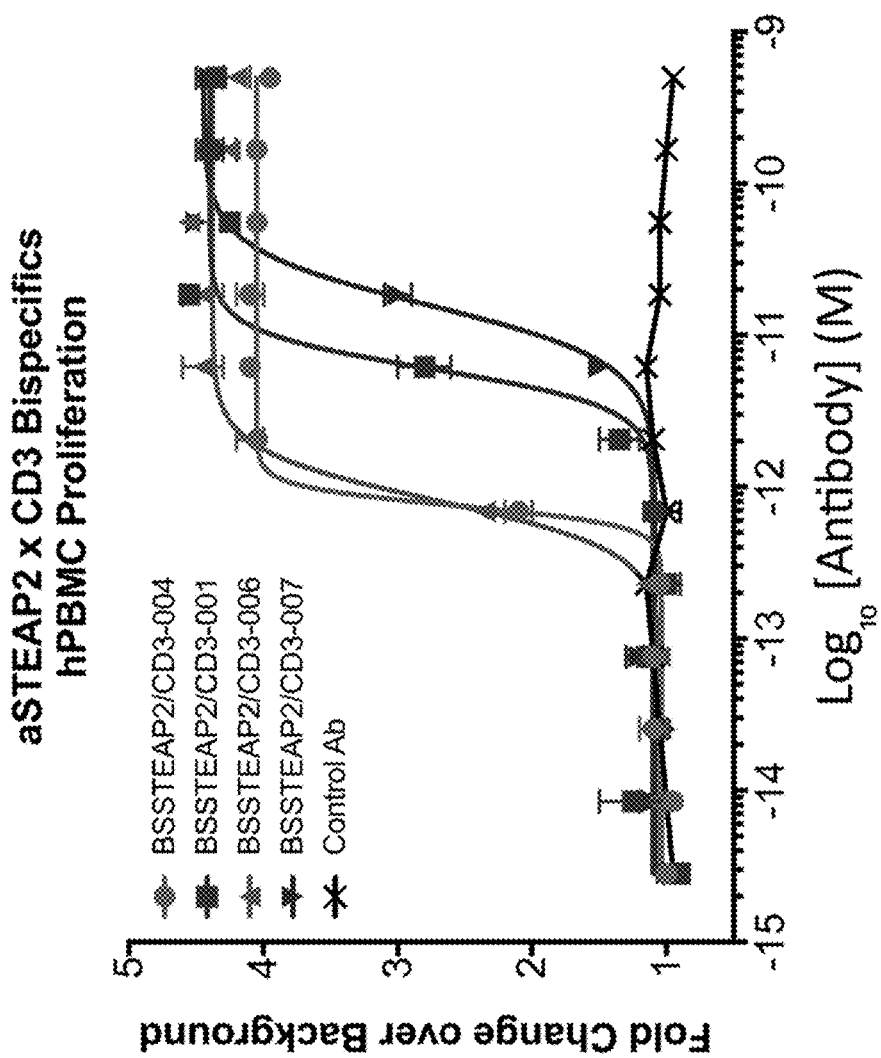
FIG. 9 shows the induction of human PBMC proliferation by STEAP2×CD3 bispecific antibodies.

All αSTEAP2×αCD3 bispecific antibodies induce human PBMC proliferation in the presence of a co-stimulatory anti-CD28 antibody (See Table 20 and FIG. 9). PBMCs were incubated with a serial dilution of bispecific antibodies or the control antibody and a fixed concentration of anti-CD28 for 72 hours, and cell viability was measured in a luminescence assay to detect live cells. Proliferation was determined by comparing luminescence of bispecific antibodies-stimulated cells to cells without antibody. $EC_{50}$ values (defined as the concentration of antibody required to generate half maximal proliferation) ranged from 3.68E-13M to 1.60E-10M. In contrast, Control antibody exhibited no activity under the same conditions.

TABLE 20

T-cell activation proliferation induced by selected STEAP2xCD3 Bispecific Antibodies

| Bispecific Antibody Designation | hPBMC Proliferation [M] | Cyno PBMC Proliferation [M] (donor) |
|---|---|---|
| BSSTEAP2/CD3-0010 | 6.55E−12 | 7.034E−13 (mk8781M) |
| BSSTEAP2/CD3-004 | 7.10E−13 | [++] (mk8781M) |
| | | [−] (mk9381M) |
| BSSTEAP2/CD3-011 | 8.62E−12 | 3.597E−12 (mk8781M) |
| BSSTEAP2/CD3-005 | 2.76E−12 | [−] (mk9381M) (mk8781M) |
| BSSTEAP2/CD3-001 | 1.60E−10 | 4.592E−12 (mk9381M) |
| | | [+] (mk8781M) |
| BSSTEAP2/CD3-006 | 8.14E−13 | 1.532E−11 (mk9381M) |
| | | [+] (mk8781M) |
| BSSTEAP2/CD3-007 | 8.26E−11 | [+/−] (mk9381M) |
| | | [+] (mk8781M) |
| BSSTEAP2/CD3-008 | 7.76E−12 | [+/−] (mk9381M) |
| | | [+] (mk8781M) |
| BSSTEAP2/CD3-009 | 3.68E−13 | [−] (mk9381M) (mk8781M) |

Figure 10:
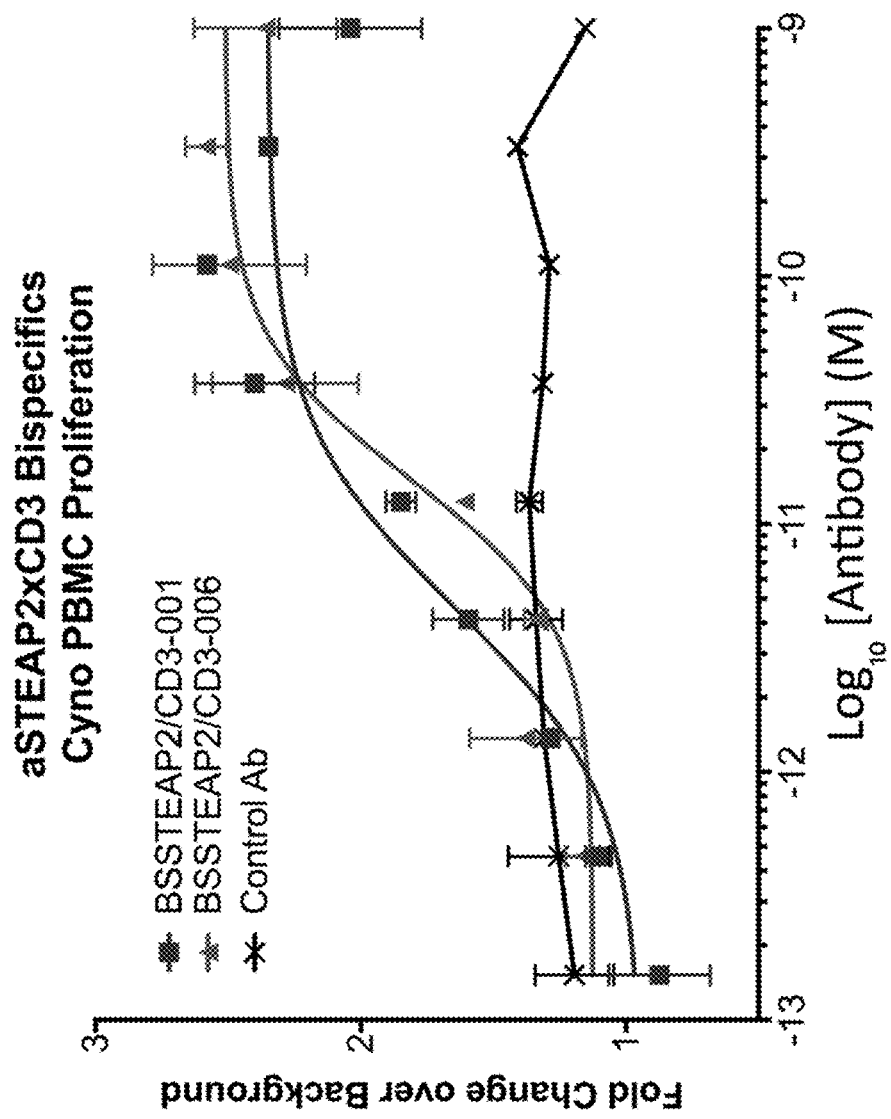
FIG. 10 shows the induction of cynomolgous PBMC proliferation by STEAP2×CD3 bispecific antibodies.

Bispecific antibodies BSSTEAP2/CD3-0010 and BSSTEAP2/CD3-011 also induced cynomolgus PBMC proliferation (with donor mk8781M) exhibiting $EC_{50}$s of 7E-13 and 3.6E-12, respectively. BSSTEAP2/CD3-004 activity was donor dependent. Two additional bispecific antibodies, BSSTEAP2/CD3-001 and BSSTEAP2/CD3-006, induced robust cynomolgus PBMC proliferation in all donors tested. $EC_{50}$ values using donor mk9381M were 4.6E-12M and 1.53E-11M, respectively (See Table 20 and FIG. 10).

BSSTEAP2/CD3-007 and BSSTEAP2/CD3-008 activity was donor dependent. In contrast, BSSTEAP2/CD3-005, BSSTEAP2/CD3-009 and isotype control exhibited no activity.

Cytotoxicity Assay Targeting C4-2 Cells in the Presence of Anti-STEAP2×CD3 Bispecific Antibodies and Human T Cells:

In order to monitor the specific killing of STEAP2-bearing target cells by flow cytometry, C4-2 cells were labeled with 1 µM of the fluorescent tracking dye Violet Cell Tracker (Life Technologies kit, # C34557). After labeling, cells were plated overnight at 37° C. Separately, human PBMCs were plated in supplemented RPMI media at $1\times10^6$ cells/mL and incubated overnight at 37° C. in order to enrich for lymphocytes by depleting adherent macrophages, dendritic cells, and some monocytes. The next day, target cells were co-incubated with adherent cell-depleted naïve PBMC (Effector/Target cell 4:1 ratio) and a serial dilution of STEAP2×CD3 bispecific antibodies or an IgG1 control antibody (does not bind to STEAP2) (concentration range: 66.7 nM to 0.25 pM) for 48 hours at 37° C. Cells were removed from cell culture plates using an enzyme-free cell dissociation buffer, and analyzed by FACS. For FACS analysis, cells were stained with a dead/live far red cell tracker (Invitrogen). $5\times10^5$ counting beads were added to each well immediately before FACS analysis. $1\times10^5$ beads were collected for each sample. For the assessment of specificity of killing, cells were gated on live Violet labeled populations. Percent of live population was recorded and used for the calculation of normalized survival.

Figure 11:
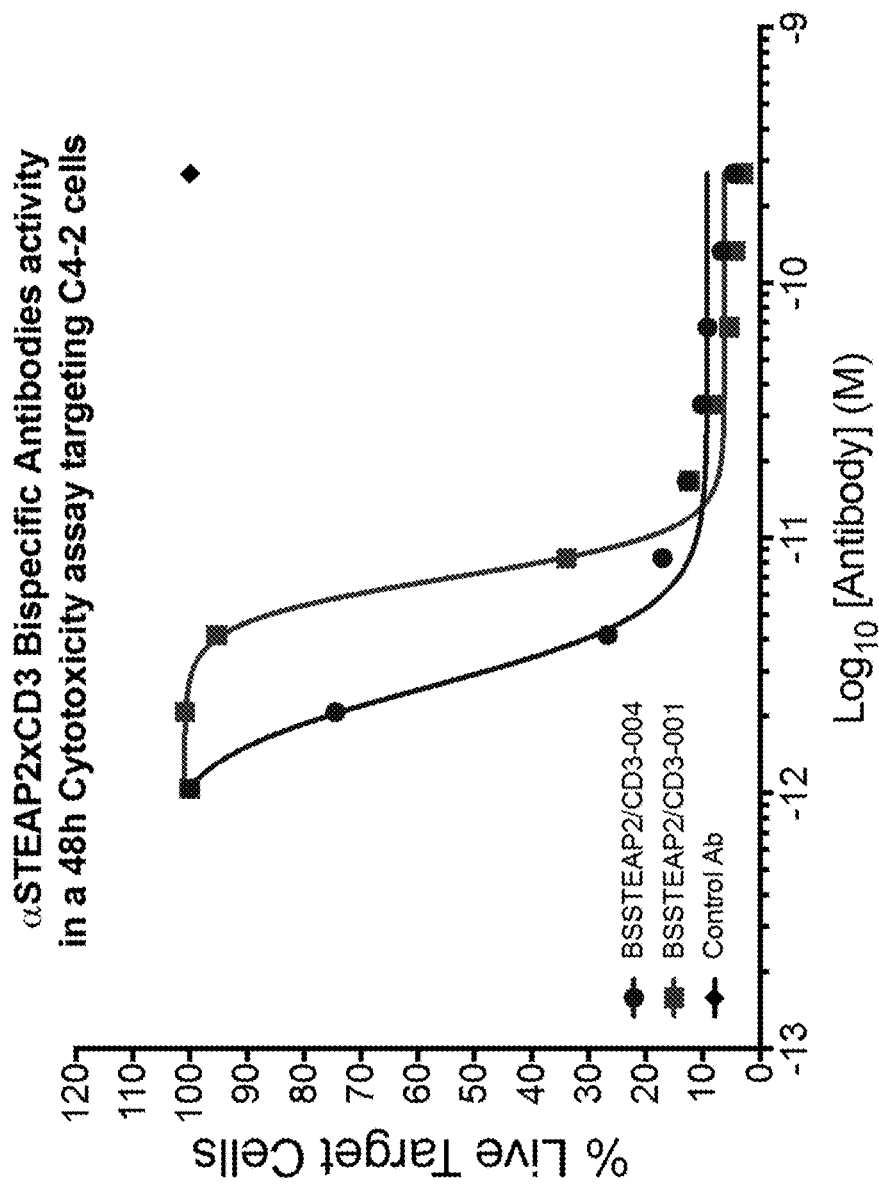
FIG. 11 shows C4-2 cell (STEAP2-bearing target cells) depletion in a cytotoxicity assay by representative STEAP2× CD3 bispecific antibodies in the presence of human PBMCs.
Figure 12:
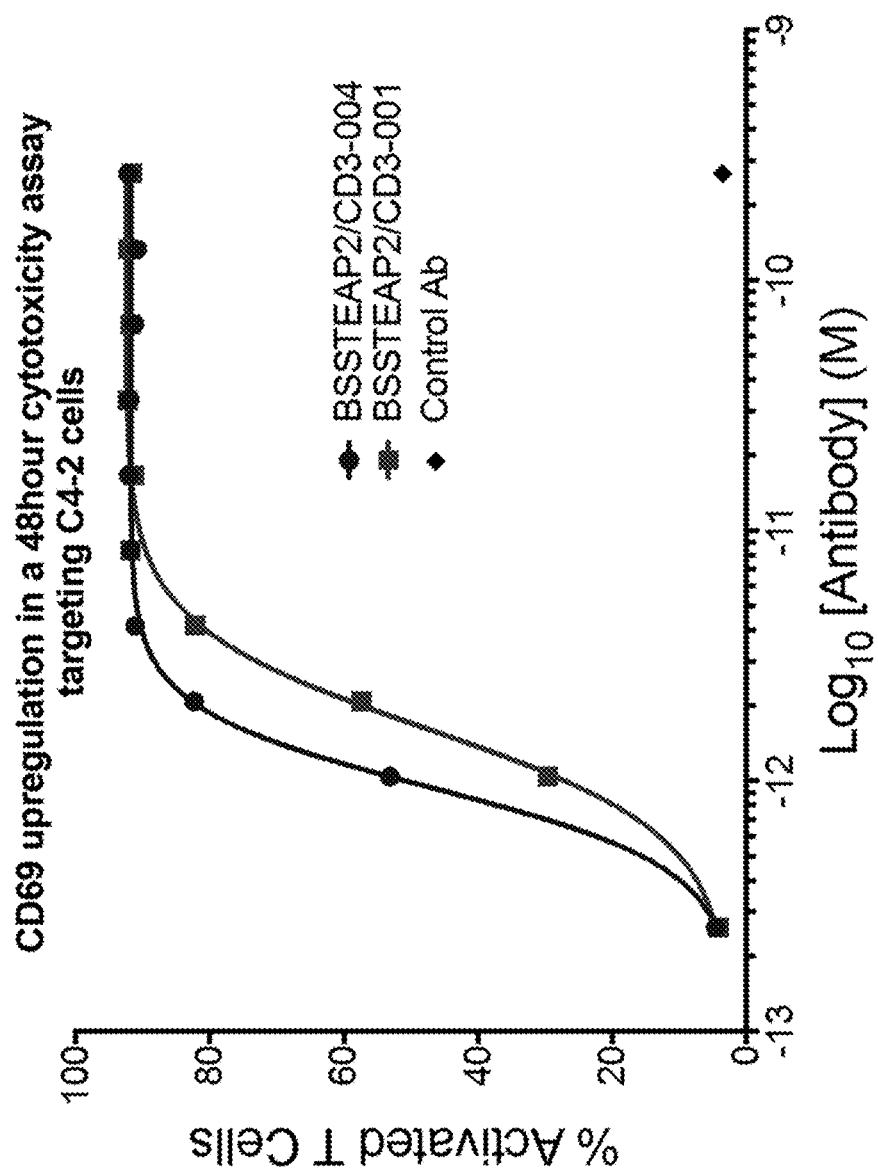
FIG. 12 shows activation of human T cells by representative STEAP2×CD3 bispecific antibodies, which correlates with the observed target-cell lysis shown in FIG. 11.

T cell activation was assessed by incubating cells with directly conjugated antibodies to CD2 and CD69, and by reporting the percent of activated (CD69+) T cells out of total T cells (CD2+). Several anti_STEAP2×CD3 bispecific antibodies were tested on their ability to induce nave T cells to kill target cells expressing human STEAP2 (See Table 21 and FIG. 11). All antibodies tested activated and directed human T cells to deplete C4-2 cells (human prostate adenocarcinoma sub line derived from LnCap cells). Target cell killing was only observed in the presence of the bispecific antibodies, with C4-2 cells depleted in a dose-dependent manner with pM EC50s. Additionally, the observed target-cell lysis was associated with upregulation of CD69 cells on CD2+ T cells, with pM EC50s (See Table 21 and FIG. 12).

TABLE 21

Cytotoxicity and T-cell activation properties of selected STEAP2xCD3 Bispecific Antibodies

| Bispecific Antibody Designation | C4-2 cells depletion EC50 [M] | T cells activation EC50 [M] |
|---|---|---|
| BSSTEAP2/CD3-004 | 3.11E−12 | 9.40E−13 |
| BSSTEAP2/CD3-005 | 7.29E−12 | +++ |
| BSSTEAP2/CD3-001 | 4.68E−12 | 1.61E−12 |
| BSSTEAP2/CD3-006 | 3.93E−12 | +++ |
| BSSTEAP2/CD3-007 | 8.11E−12 | +++ |
| BSSTEAP2/CD3-008 | 4.11E−12 | +++ |
| BSSTEAP2/CD3-009 | 2.73E−12 | +++ |

The present invention is not to be limited in scope by the specific embodiments described herein. Indeed, various modifications of the invention in addition to those described herein will become apparent to those skilled in the art from the foregoing description. Such modifications are intended to fall within the scope of the appended claims.

SEQUENCE LISTING (1934 sequences)

SEQ ID NO: 1 - DNA, 399 bp, Artificial Sequence
  Synthetic
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactataggtccaagtggtataatgattatgcagtatctgtgaaaagtcgaataaccatcaacccagacacatccaagaaccagttctccctgcacctgaactctgtgactcccgaggacacggctgtgtattactgtgcaagggcgggaattgtagtagtaccaggtccggatatttattactactactactacggtatggacgtctggggccaagggaccacggtcaccgtctcctca

SEQ ID NO: 2 - protein, 133 aa, Artificial Sequence
  Synthetic
QVQLQQSGPGLVKPSQTLSLTCAISGDSVSSNSAAWNWIRQSPSRGLEWLGRTYYRSKWYNDYAVSVKSRITINPDTSKNQFSLHLNSVTPEDTAVYYCARAGIVVVPGPDIYYYYYYGMDVWGQGTTVTVSS

SEQ ID NO: 3 - DNA, 30 bp, Artificial Sequence
  Synthetic
ggggacagtgtctctagcaacagtgctgct

SEQ ID NO: 4 - protein, 10 aa, Artificial Sequence
  Synthetic
GDSVSSNSAA

SEQ ID NO: 5 - DNA, 27 bp, Artificial Sequence
  Synthetic
acatactataggtccaagtggtataat

SEQ ID NO: 6 - protein, 9 aa, Artificial Sequence
  Synthetic
TYYRSKWYN

SEQ ID NO: 7 - DNA, 69 bp, Artificial Sequence
  Synthetic
gcaagggcgggaattgtagtagtaccaggtccggatatttattactactactactacggtatggacgtc

SEQ ID NO: 8 - protein, 23 aa, Artificial Sequence
  Synthetic
ARAGIVVVPGPDIYYYYYYGMDV

SEQ ID NO: 9 - DNA, 324 bp, Artificial Sequence
  Synthetic
gacatccagatgacccagtctccatcctccctgtctgcatctgtaggagacagagtcaccatcacttgccgggcaagtcagagcattagaagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 10 - protein, 108 aa, Artificial Sequence
  Synthetic
DIQMTQSPSSLSASVGDRVTITCRASQSIRSYLNWYQQKPGKAPKLLIYAASSLQSGVPSRFSGSGSGTDFTLTISSLQPEDFATYYCQQSYSTPPITFGQGTRLEIK

SEQ ID NO: 11 - DNA, 18 bp, Artificial Sequence
  Synthetic
cagagcattagaagctat

SEQ ID NO: 12 - protein, 6 aa, Artificial Sequence
  Synthetic
QSIRSY

SEQ ID NO: 13 - DNA, 9 bp, Artificial Sequence
  Synthetic
gctgcatcc

SEQ ID NO: 14 - protein, 3 aa, Artificial Sequence
  Synthetic
AAS

SEQ ID NO: 15 - DNA, 30 bp, Artificial Sequence
  Synthetic
caacagagttacagtacccctccgatcacc

SEQ ID NO: 16 - protein, 10 aa, Artificial Sequence
  Synthetic
QQSYSTPPIT

SEQ ID NO: 17 - DNA, 381 bp, Artificial Sequence
  Synthetic
caggtgcagctggtgcagtctggggctgaggtgaagaagcctggggcctcagtgaaggtctcctgcaaggcttctggatacaccttcaccggctacgatatgcactgggtgcgacaggcccctgggcaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagaattgggatggtagtatcaggtgctaattactactactactacggtatggacgtctggggccaagggaccacggtcaccgtctcctca

SEQ ID NO: 18 - protein, 127 aa, Artificial Sequence
  Synthetic
QVQLVQSGAEVKKPGASVKVSCKASGYTFTGYDMHWVRQAPGQGLEWMGWINPNSGGTNYAQKFQGRVTMTRDTSISTAYMELSRLRSDDTAVYYCARIGMVVSGANYYYYYGMDVWGQGTTVTVSS

SEQ ID NO: 19 - DNA, 24 bp, Artificial Sequence
  Synthetic
ggatacaccttcaccggctacgat

SEQ ID NO: 20 - protein, 8 aa, Artificial Sequence
  Synthetic
GYTFTGYD

SEQ ID NO: 21 - DNA, 24 bp, Artificial Sequence
  Synthetic
atcaaccctaacagtggtggcaca

SEQ ID NO: 22 - protein, 8 aa, Artificial Sequence
  Synthetic
INPNSGGT

SEQ ID NO: 23 - DNA, 60 bp, Artificial Sequence
  Synthetic
gcgagaattgggatggtagtatcaggtgctaattactactactactacggtatggacgtc

SEQ ID NO: 24 - protein, 20 aa, Artificial Sequence
  Synthetic
ARIGMVVSGANYYYYYGMDV

SEQ ID NO: 25 - DNA, 321 bp, Artificial Sequence
  Synthetic
gccatccagatgacccagtctccatcctccctgtctgcatatgtaggagacagagtcatcatcacttgccgggcaagtcagggcattagaaatgatttaggctggtatcagcagaaaccagggaaagcccctaagctcctgatctatgctgcatccagtttacaaagtggggtcccatcaaggttcagcggcagtagatctggcacagttttcactctcaccatcagcagcctgcagcctgaagattttgcaacttattactgtctgcaagattacaattacccgtggacgttcggccaagggaccaaggtggaaatcaaa

SEQ ID NO: 26 - protein, 107 aa, Artificial Sequence
  Synthetic
AIQMTQSPSSLSAYVGDRVIITCRASQGIRNDLGWYQQKPGKAPKLLIYAASSLQSGVPSRFSGSRSGTVFTLTISSLQPEDFATYYCLQDYNYPWTFGQGTKVEIK

SEQ ID NO: 27 - DNA, 18 bp, Artificial Sequence
  Synthetic
cagggcattagaaatgat

SEQ ID NO: 28 - protein, 6 aa, Artificial Sequence
  Synthetic
QGIRND

SEQ ID NO: 29 - DNA, 9 bp, Artificial Sequence
  Synthetic
gctgcatcc

SEQ ID NO: 30 - protein, 3 aa, Artificial Sequence
  Synthetic
AAS

SEQ ID NO: 31 - DNA, 27 bp, Artificial Sequence
  Synthetic
ctgcaagattacaattacccgtggacg

SEQ ID NO: 32 - protein, 9 aa, Artificial Sequence
  Synthetic
LQDYNYPWT

SEQ ID NO: 33 - DNA, 360 bp, Artificial Sequence
  Synthetic
gaggtgcagctggtggagtctgggggaggcttggtccagcctggggggtccctgagactctcctgtgcagcctctggattcaccttcagtacctatgctatgcactgggtccgccaggctccagggaagggactgcaacatgtttcaactattagtactaatggggttaacacatattatgcagactctgtgaagggcagattcaccatctccagagacaattccaagagcacgctgtatcttcaaatgggcagcctgagagctgaggacatggctgtatattactgtgcgagagataaagatttttggagtggttattttgactactggggccagggaaccctggtcaccgtctcctca

SEQ ID NO: 34 - protein, 120 aa, Artificial Sequence
  Synthetic
EVQLVESGGGLVQPGGSLRLSCAASGFTFSTYAMHWVRQAPGKGLQHVSTISTNGVNTYYADSVKGRFTISRDNSKSTLYLQMGSLRAEDMAVYYCARDKDFWSGYFDYWGQGTLVTVSS

SEQ ID NO: 35 - DNA, 24 bp, Artificial Sequence
  Synthetic
ggattcaccttcagtacctatgct

SEQ ID NO: 36 - protein, 8 aa, Artificial Sequence
  Synthetic
GFTFSTYA

SEQ ID NO: 37 - DNA, 24 bp, Artificial Sequence
  Synthetic
attagtactaatggggttaacaca

SEQ ID NO: 38 - protein, 8 aa, Artificial Sequence
  Synthetic
ISTNGVNT

SEQ ID NO: 39 - DNA, 39 bp, Artificial Sequence
  Synthetic
gcgagagataaagatttttggagtggttattttgactac

SEQ ID NO: 40 - protein, 13 aa, Artificial Sequence
  Synthetic
ARDKDFWSGYFDY

SEQ ID NO: 41 - DNA, 321 bp, Artificial Sequence
  Synthetic
gaaattgtgatgacgcagtctccaggcaccctgtctgtgtctccaggggaaagagccaccctctcctgtagggccagtcagagtgttagtagcaacttagcctggtaccaccagaaacctggccaggctcccaggctcctcatctatggtgcatccaccagggccactggtttcccagccaggttcagtggcagtgggtctgggacagagttcactctcaccatcagcagcctgcagtcggaagattttgcagcttattactgtcagcagtataataattggcccatcaccttcggccaagggacacgactggagattaaa

SEQ ID NO: 42 - protein, 107 aa, Artificial Sequence
  Synthetic
EIVMTQSPGTLSVSPGERATLSCRASQSVSSNLAWYHQKPGQAPRLLIYGASTRATGFPARFSGSGSGTEFTLTISSLQSEDFAAYYCQQYNNWPITFGQGTRLEIK

SEQ ID NO: 43 - DNA, 18 bp, Artificial Sequence
  Synthetic
cagagtgttagtagcaac

SEQ ID NO: 44 - protein, 6 aa, Artificial Sequence
  Synthetic
QSVSSN

SEQ ID NO: 45 - DNA, 9 bp, Artificial Sequence
  Synthetic
ggtgcatcc

SEQ ID NO: 46 - protein, 3 aa, Artificial Sequence
  Synthetic
GAS

SEQ ID NO: 47 - DNA, 27 bp, Artificial Sequence
  Synthetic
cagcagtataataattggcccatcacc

SEQ ID NO: 48 - protein, 9 aa, Artificial Sequence
  Synthetic
QQYNNWPIT

SEQ ID NO: 49 - DNA, 363 bp, Artificial Sequence
  Synthetic
caggtgcagctgcaggagtcgggcccaggactggtgaagccttcacagaccctgtccctcacctgcactgtctctggttactccatcaacagtggtggtcatttctggagctggatccgccagcacccagggaagggcctggagtggattggggacatctattacagtgggaacacctactccattccgtccctcaagcgtcgaatttccatgtcagtagacacgtctaagaaccacttctccctgaaactgatctctgtgacggccgcggacacggccatttattactgtgcgagaaatagtgggggctatcttgatgcttttgatatctggggccaagggacaatggtcaccgtctcttca

SEQ ID NO: 50 - protein, 121 aa, Artificial Sequence
  Synthetic
QVQLQESGPGLVKPSQTLSLTCTVSGYSINSGGHFWSWIRQHPGKGLEWIGDIYYSGNTYSIPSLKRRISMSVDTSKNHFSLKLISVTAADTAIYYCARNSGGYLDAFDIWGQGTMVTVSS

SEQ ID NO: 51 - DNA, 30 bp, Artificial Sequence
  Synthetic
ggttactccatcaacagtggtggtcatttc

SEQ ID NO: 52 - protein, 10 aa, Artificial Sequence
  Synthetic
GYSINSGGHF

SEQ ID NO: 53 - DNA, 21 bp, Artificial Sequence
  Synthetic
atctattacagtgggaacacc

SEQ ID NO: 54 - protein, 7 aa, Artificial Sequence
  Synthetic
IYYSGNT

SEQ ID NO: 55 - DNA, 39 bp, Artificial Sequence
  Synthetic
gcgagaaatagtgggggctatcttgatgcttttgatatc

SEQ ID NO: 56 - protein, 13 aa, Artificial Sequence
  Synthetic
ARNSGGYLDAFDI

SEQ ID NO: 57 - DNA, 324 bp, Artificial Sequence
  Synthetic
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccgtcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 58 - protein, 108 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPITFGQGTRLEIK

SEQ ID NO: 59 - DNA, 18 bp, Artificial Sequence
  Synthetic
cagagcattagcagctat

SEQ ID NO: 60 - protein, 6 aa, Artificial Sequence
  Synthetic
QSISSY

SEQ ID NO: 61 - DNA, 9 bp, Artificial Sequence
  Synthetic
gctgcatcc

SEQ ID NO: 62 - protein, 3 aa, Artificial Sequence
  Synthetic
AAS

SEQ ID NO: 63 - DNA, 30 bp, Artificial Sequence; identical to SEQ ID NO: 15
  Synthetic

SEQ ID NO: 64 - protein, 10 aa, Artificial Sequence
  Synthetic
QQSYSTPPIT

SEQ ID NO: 65 - DNA, 387 bp, Artificial Sequence
  Synthetic
gaggtgcagctggtggagtctgggggaggcttggtacagccgggggggtccctgagactctcctgtgcaacctctggattcaccttcagtaactacgacttccactgggtccgccaaattagaggacaaggtctggagtgggtctctactattgacactgctggtgacacatacttttcaggctccgtgaagggccgcttcaccatctccagagacactgccaaaacctccttgtatcttcaaatgaacagcctgagagccggggacacggctgtgtattactgtgcaagagcccctcgttatgatagtactggtaactactacaattactattcctatttcggcctggacgtctggggccaagggaccacggtcaccgtctcctca

SEQ ID NO: 66 - protein, 129 aa, Artificial Sequence
  Synthetic
EVQLVESGGGLVQPGGSLRLSCATSGFTFSNYDFHWVRQIRGQGLEWVSTIDTAGDTYFSGSVKGRFTISRDTAKTSLYLQMNSLRAGDTAVYYCARAPRYDSTGNYYNYYSYFGLDVWGQGTTVTVSS

SEQ ID NO: 67 - DNA, 24 bp, Artificial Sequence
  Synthetic
ggattcaccttcagtaactacgac

SEQ ID NO: 68 - protein, 8 aa, Artificial Sequence
  Synthetic
GFTFSNYD

SEQ ID NO: 69 - DNA, 21 bp, Artificial Sequence
  Synthetic
attgacactgctggtgacaca

SEQ ID NO: 70 - protein, 7 aa, Artificial Sequence
  Synthetic
IDTAGDT

SEQ ID NO: 71 - DNA, 69 bp, Artificial Sequence
  Synthetic
gcaagagcccctcgttatgatagtactggtaactactacaattactattcctatttcggcctggacgtc

SEQ ID NO: 72 - protein, 23 aa, Artificial Sequence
  Synthetic
ARAPRYDSTGNYYNYYSYFGLDV

SEQ ID NO: 73 - DNA, 375 bp, Artificial Sequence
  Synthetic
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaagttttgatcctgaagatgatgaaacaatctacgcacagaagttccagggcagagtcaccatgaccgaggacacatctacagacacagcctacatggacctgagcagcctaagatctgaggacacggccgtgtattactgttcaatagaggaagttcgttggcggggatcggactactactacgttatggacgtctggggccaagggaccacggtcaccgtctcctca

SEQ ID NO: 74 - protein, 125 aa, Artificial Sequence
  Synthetic
QVQLVQSGAEVKKPGASVKVSCKVSGYTLTELSMHWVRQAPGKGLEWMGSFDPEDDETIYAQKFQGRVTMTEDTSTDTAYMDLSSLRSEDTAVYYCSIEEVRWRGSDYYYVMDVWGQGTTVTVSS

SEQ ID NO: 75 - DNA, 24 bp, Artificial Sequence
  Synthetic
ggatacaccctcactgaattatcc

SEQ ID NO: 76 - protein, 8 aa, Artificial Sequence
  Synthetic
GYTLTELS

SEQ ID NO: 77 - DNA, 24 bp, Artificial Sequence
  Synthetic
tttgatcctgaagatgatgaaaca

SEQ ID NO: 78 - protein, 8 aa, Artificial Sequence
  Synthetic
FDPEDDET

SEQ ID NO: 79 - DNA, 54 bp, Artificial Sequence
  Synthetic
tcaatagaggaagttcgttggcggggatcggactactactacgttatggacgtc

SEQ ID NO: 80 - protein, 18 aa, Artificial Sequence
  Synthetic
SIEEVRWRGSDYYYVMDV

SEQ ID NO: 81 - DNA, 372 bp, Artificial Sequence
  Synthetic
caggtgcagctggtgcagtctggggctgaggtgaagaagcctgggtcctcggtgaaggtctcctgcagggcttctggaggcaccttcagcagatttgctatcggctgggtgcgacaggcccctggacaagggcttgagtggatgggagggatcatccctatctttggtacagcaagctacgcacagaagttccagggcagagtcacgattaccacggacgaatccacgagcacagcctacatggagttgcgaagcctgagatctgaggacacggccgtatattactgtacgagagaaggtataactggtcgaggctactactactacggtatggacgtctggggccaagggaccacggtcaccgtctcctca

SEQ ID NO: 82 - protein, 124 aa, Artificial Sequence
  Synthetic
QVQLVQSGAEVKKPGSSVKVSCRASGGTFSRFAIGWVRQAPGQGLEWMGGIIPIFGTASYAQKFQGRVTITTDESTSTAYMELRSLRSEDTAVYYCTREGITGRGYYYYGMDVWGQGTTVTVSS

SEQ ID NO: 83 - DNA, 24 bp, Artificial Sequence
  Synthetic
ggaggcaccttcagcagatttgct

SEQ ID NO: 84 - protein, 8 aa, Artificial Sequence
  Synthetic
GGTFSRFA

SEQ ID NO: 85 - DNA, 24 bp, Artificial Sequence
  Synthetic
atcatccctatctttggtacagca

SEQ ID NO: 86 - protein, 8 aa, Artificial Sequence
  Synthetic
IIPIFGTA

SEQ ID NO: 87 - DNA, 51 bp, Artificial Sequence
  Synthetic
acgagagaaggtataactggtcgaggctactactactacggtatggacgtc

SEQ ID NO: 88 - protein, 17 aa, Artificial Sequence
  Synthetic
TREGITGRGYYYYGMDV

SEQ ID NO: 89 - DNA, 357 bp, Artificial Sequence
  Synthetic
caggtgcagctgcaggagtcgggcccaggactggtgaagccttcggagaccctgtccctcacctgcactgtctctggtggctccatcagtatttactactggacctggatccggcagcccccagggaagggactggagtggattgggaatatcttttacagtgggagcaccaactacaacccctccctcaagagtcgagtcaccatatcagtagacacgtccaagaatcagttttccctgaagttgagctctgtgaccgctgcggacacggccgtgtattactgtgcgagagagagactggggcgttacgatgcttttgataattggggccaagggacaatggtcaccgtctcttca

SEQ ID NO: 90 - protein, 119 aa, Artificial Sequence
  Synthetic
QVQLQESGPGLVKPSETLSLTCTVSGGSISIYYWTWIRQPPGKGLEWIGNIFYSGSTNYNPSLKSRVTISVDTSKNQFSLKLSSVTAADTAVYYCARERLGRYDAFDNWGQGTMVTVSS

SEQ ID NO: 91 - DNA, 24 bp, Artificial Sequence
  Synthetic
ggtggctccatcagtatttactac

SEQ ID NO: 92 - protein, 8 aa, Artificial Sequence
  Synthetic
GGSISIYY

SEQ ID NO: 93 - DNA, 21 bp, Artificial Sequence
  Synthetic
atcttttacagtgggagcacc

SEQ ID NO: 94 - protein, 7 aa, Artificial Sequence
  Synthetic
IFYSGST

SEQ ID NO: 95 - DNA, 39 bp, Artificial Sequence
  Synthetic
gcgagagagagactggggcgttacgatgcttttgataat

SEQ ID NO: 96 - protein, 13 aa, Artificial Sequence
  Synthetic
ARERLGRYDAFDN

SEQ ID NO: 97 - DNA, 366 bp, Artificial Sequence
  Synthetic
gaggtgcagctggtggagtctgggggaggcttggtacagcctggggggtccctgagactctcctgtgcagcctctagattcacctttagtagctatgccatgagttgggtccgccaggctccagggaaggggctggagtgggtctcacttattagtggtagtggtggtaggacatggtacgcagactccgtgaagggccggttcaccatctccagagacaattccaagaacacgctgtttctgcaaatgaacagcctgagagccgaggacacggccgtctattactgtgcgaaagaaggggggatttttggagtggttaccttctttgactactggggccagggaaccctggtcaccgtctcctca

SEQ ID NO: 98 - protein, 122 aa, Artificial Sequence
  Synthetic
EVQLVESGGGLVQPGGSLRLSCAASRFTFSSYAMSWVRQAPGKGLEWVSLISGSGGRTWYADSVKGRFTISRDNSKNTLFLQMNSLRAEDTAVYYCAKEGGIFGVVTFFDYWGQGTLVTVSS

SEQ ID NO: 99 - DNA, 24 bp, Artificial Sequence
  Synthetic
agattcacctttagtagctatgcc

SEQ ID NO: 100 - protein, 8 aa, Artificial Sequence
  Synthetic
RFTFSSYA

SEQ ID NO: 101 - DNA, 24 bp, Artificial Sequence
  Synthetic
attagtggtagtggtggtaggaca

SEQ ID NO: 102 - protein, 8 aa, Artificial Sequence
  Synthetic
ISGSGGRT

SEQ ID NO: 103 - DNA, 45 bp, Artificial Sequence
  Synthetic
gcgaaagaaggggggatttttggagtggttaccttctttgactac

SEQ ID NO: 104 - protein, 15 aa, Artificial Sequence
  Synthetic
AKEGGIFGVVTFFDY

SEQ ID NO: 105 - DNA, 360 bp, Artificial Sequence
  Synthetic
gaggtgcagctggtggagtctgggggaggcttggtacagcctggggggtccctgagactctcctgtgcagtctctggattcacctttagcagctatgccatgagctgggtccgccaggctccagggaaggggctggagtgggtctcagttattagtggtagtggtgatttcacataccacgcagactccgtgaagggccggttcaccatctccagagacaattccaagtccacgctgtatctgcaattgaacagcctgagagccgaggacacggccgtatattactgtgcgaaaaagggcttacgatattttgactggtacgactactggggccagggaaccctggtcaccgtctcctca

SEQ ID NO: 106 - protein, 120 aa, Artificial Sequence
  Synthetic
EVQLVESGGGLVQPGGSLRLSCAVSGFTFSSYAMSWVRQAPGKGLEWVSVISGSGDFTYHADSVKGRFTISRDNSKSTLYLQLNSLRAEDTAVYYCAKKGLRYFDWYDYWGQGTLVTVSS

SEQ ID NO: 107 - DNA, 24 bp, Artificial Sequence
  Synthetic
ggattcacctttagcagctatgcc

SEQ ID NO: 108 - protein, 8 aa, Artificial Sequence
  Synthetic
GFTFSSYA

SEQ ID NO: 109 - DNA, 24 bp, Artificial Sequence
  Synthetic
attagtggtagtggtgatttcaca

SEQ ID NO: 110 - protein, 8 aa, Artificial Sequence
  Synthetic
ISGSGDFT

SEQ ID NO: 111 - DNA, 39 bp, Artificial Sequence
  Synthetic
gcgaaaaagggcttacgatattttgactggtacgactac

SEQ ID NO: 112 - protein, 13 aa, Artificial Sequence
  Synthetic
AKKGLRYFDWYDY

SEQ ID NO: 113 - DNA, 324 bp, Artificial Sequence
  Synthetic
gaaatagttttgacacagagtcccggcacactgtcactctctcccggggaaagagccaccttgtcatgtagagcaagtcagtcagtctctagctcttatctcgcctggtaccagcagaagccgggacaggcccctagactgctgatctacggggcaagttccagggccaccggaatccccgaccggttcagtggaagcggaagcggaaccgattttactttgacgatttctagactggagccagaggatttcgccgtttactattgtcaacagtacggaagcagcccgtggacgtttggccagggcacgaaggtagaaatcaag

SEQ ID NO: 114 - protein, 108 aa, Artificial Sequence
  Synthetic
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 115 - DNA, 36 bp, Artificial Sequence
  Synthetic
agagcaagtcagtcagtctctagctcttatctcgcc

SEQ ID NO: 116 - protein, 12 aa, Artificial Sequence
  Synthetic
RASQSVSSSYLA

SEQ ID NO: 117 - DNA, 21 bp, Artificial Sequence
  Synthetic
ggggcaagttccagggccacc

SEQ ID NO: 118 - protein, 7 aa, Artificial Sequence
  Synthetic
GASSRAT

SEQ ID NO: 119 - DNA, 27 bp, Artificial Sequence
  Synthetic
caacagtacggaagcagcccgtggacg

SEQ ID NO: 120 - protein, 9 aa, Artificial Sequence
  Synthetic
QQYGSSPWT

SEQ ID NO: 121 - DNA, 375 bp, Artificial Sequence
  Synthetic
caggtgcagctgcaggagtcgggcccaggactggtgaagccttcggagaccctgtccctcacctgcactgtctctggtggctccatcagtagttactactggacctggatccggcagaccccagggaagggactggagtggattgggtatatttattacagtgggagcaccaactacaacccctccctcaagagtcgagtcaccatatcagtagacacgtccaagaaccagttctccctgaagctgaggtctgtggccgctgcggacacggccgtttattactgtgcgagagggacttactaccgtgatagtagtggaaaatatttcaactggttcgacccctggggccagggaaccctggtcaccgtctcctca

SEQ ID NO: 122 - protein, 125 aa, Artificial Sequence
  Synthetic
QVQLQESGPGLVKPSETLSLTCTVSGGSISSYYWTWIRQTPGKGLEWIGYIYYSGSTNYNPSLKSRVTISVDTSKNQFSLKLRSVAAADTAVYYCARGTYYRDSSGKYFNWFDPWGQGTLVTVSS

SEQ ID NO: 123 - DNA, 24 bp, Artificial Sequence
  Synthetic
ggtggctccatcagtagttactac

SEQ ID NO: 124 - protein, 8 aa, Artificial Sequence
  Synthetic
GGSISSYY

SEQ ID NO: 125 - DNA, 21 bp, Artificial Sequence
  Synthetic
atttattacagtgggagcacc

SEQ ID NO: 126 - protein, 7 aa, Artificial Sequence
  Synthetic
IYYSGST

SEQ ID NO: 127 - DNA, 57 bp, Artificial Sequence
  Synthetic
gcgagagggacttactaccgtgatagtagtggaaaatatttcaactggttcgacccc

SEQ ID NO: 128 - protein, 19 aa, Artificial Sequence
  Synthetic
ARGTYYRDSSGKYFNWFDP

SEQ ID NO: 129 - DNA, 321 bp, Artificial Sequence
  Synthetic
gacatccagatgacccagtctccatcttccgtgtctgcatctgtaggagacagagtcaccatcacttgtcgggcgagtcaggatattagcaactggttagcctggtatcagcagaaaccagggaaagcccctaagctcctgatctatgctgcatccagtttgcaaagtggggtcccatccaggttcagtggtagtggatctgggacagatttcactctctccatcagcagcctgcagtctgaagattttgcaacttactattgtcaacaggctaaaggtttccctcggacgttcggccaagggaccaaggtggaaatcaaa

SEQ ID NO: 130 - protein, 107 aa, Artificial Sequence
  Synthetic
DIQMTQSPSSVSASVGDRVTITCRASQDISNWLAWYQQKPGKAPKLLIYAASSLQSGVPSRFSGSGSGTDFTLSISSLQSEDFATYYCQQAKGFPRTFGQGTKVEIK

SEQ ID NO: 131 - DNA, 18 bp, Artificial Sequence
  Synthetic
caggatattagcaactgg

SEQ ID NO: 132 - protein, 6 aa, Artificial Sequence
  Synthetic
QDISNW

SEQ ID NO: 133 - DNA, 9 bp, Artificial Sequence
  Synthetic
gctgcatcc

SEQ ID NO: 134 - protein, 3 aa, Artificial Sequence
  Synthetic
AAS

SEQ ID NO: 135 - DNA, 27 bp, Artificial Sequence
  Synthetic
caacaggctaaaggtttccctcggacg

SEQ ID NO: 136 - protein, 9 aa, Artificial Sequence
  Synthetic
QQAKGFPRT

SEQ ID NO: 137 - DNA, 375 bp, Artificial Sequence
  Synthetic
caggtgcagctggtggagtctgggggaggcgtggtccagcctgggaggtccctgagactctcctgtgcagcctctggattcaccttcagtagctttggcatgcactgggtccgccaggctccaggcaaggggctggagtgggtgtcacttatatcatatgatggtgataataaatactatgtagactccgtgaagggccgattcaccatctccagagacaattccgagaacacgctgtatctgcaaatgaacaacctgcgacctgaggacacggctttctattactgtgcgaaagatggatttactagtggctggtacggctcctacaccggtttggacgtctggggccaagggaccacggtcaccgtctcctca

SEQ ID NO: 138 - protein, 125 aa, Artificial Sequence
  Synthetic
QVQLVESGGGVVQPGRSLRLSCAASGFTFSSFGMHWVRQAPGKGLEWVSLISYDGDNKYYVDSVKGRFTISRDNSENTLYLQMNNLRPEDTAFYYCAKDGFTSGWYGSYTGLDVWGQGTTVTVSS

SEQ ID NO: 139 - DNA, 24 bp, Artificial Sequence
  Synthetic
ggattcaccttcagtagctttggc

SEQ ID NO: 140 - protein, 8 aa, Artificial Sequence
  Synthetic
GFTFSSFG

SEQ ID NO: 141 - DNA, 24 bp, Artificial Sequence
  Synthetic
atatcatatgatggtgataataaa

SEQ ID NO: 142 - protein, 8 aa, Artificial Sequence
  Synthetic
ISYDGDNK

SEQ ID NO: 143 - DNA, 54 bp, Artificial Sequence
  Synthetic
gcgaaagatggatttactagtggctggtacggctcctacaccggtttggacgtc

SEQ ID NO: 144 - protein, 18 aa, Artificial Sequence
  Synthetic
AKDGFTSGWYGSYTGLDV

SEQ ID NO: 145 - DNA, 321 bp, Artificial Sequence
  Synthetic
gacatccagatgacccagtctccatcctccctgtctgcatctgtaggagacagagtcaccatcacttgccgggcaagtcagggcattagaaatgatttaggctggtatcagcagaatccagggagagcccctaagcgcctgatctatgctgcatccagtttgcaaagtggggtcccatcaaggttcagcggcagtggatctgggacagaattcactctcacaatcagcagcctgcagcctgaagattttgcaacttattactgtcttcagtataatagttaccctcggacgttcggccaagggaccaaggtggaaatcaaa

SEQ ID NO: 146 - protein, 107 aa, Artificial Sequence
  Synthetic
DIQMTQSPSSLSASVGDRVTITCRASQGIRNDLGWYQQNPGRAPKRLIYAASSLQSGVPSRFSGSGSGTEFTLTISSLQPEDFATYYCLQYNSYPRTFGQGTKVEIK

SEQ ID NO: 147 - DNA, 18 bp, Artificial Sequence
  Synthetic
cagggcattagaaatgat

SEQ ID NO: 148 - protein, 6 aa, Artificial Sequence
  Synthetic
QGIRND

SEQ ID NO: 149 - DNA, 9 bp, Artificial Sequence
  Synthetic
gctgcatcc

SEQ ID NO: 150 - protein, 3 aa, Artificial Sequence
  Synthetic
AAS

SEQ ID NO: 151 - DNA, 27 bp, Artificial Sequence
  Synthetic
cttcagtataatagttaccctcggacg

SEQ ID NO: 152 - protein, 9 aa, Artificial Sequence
  Synthetic
LQYNSYPRT

SEQ ID NO: 153 - DNA, 360 bp, Artificial Sequence
  Synthetic
gaggtgcagctggtggagtctgggggaggctgggtacagcctggggggtccctgagactctcctgtgcagcctctggattcacattcagtaacttcgacatgcactgggtccgccaagctgcaggaaaaggtctggagtgggtctcaattattgatactggtggtgacacatactatccgggctccgtgaagggccgattcaccatatccagagaagatgccaagaactccttctatcttcaaatgaacagcctgagagccggggacacggctatatattactgtgtaagaggggggtataccagtggctgggactactttgactactggggccagggaaccctggtcaccgtctcctca

SEQ ID NO: 154 - protein, 120 aa, Artificial Sequence
  Synthetic
EVQLVESGGGWVQPGGSLRLSCAASGFTFSNFDMHWVRQAAGKGLEWVSIIDTGGDTYYPGSVKGRFTISREDAKNSFYLQMNSLRAGDTAIYYCVRGGYTSGWDYFDYWGQGTLVTVSS

SEQ ID NO: 155 - DNA, 24 bp, Artificial Sequence
  Synthetic
ggattcacattcagtaacttcgac

SEQ ID NO: 156 - protein, 8 aa, Artificial Sequence
  Synthetic
GFTFSNFD

SEQ ID NO: 157 - DNA, 21 bp, Artificial Sequence
  Synthetic
attgatactggtggtgacaca

SEQ ID NO: 158 - protein, 7 aa, Artificial Sequence
  Synthetic
IDTGGDT

SEQ ID NO: 159 - DNA, 42 bp, Artificial Sequence
  Synthetic
gtaagaggggggtataccagtggctgggactactttgactac

SEQ ID NO: 160 - protein, 14 aa, Artificial Sequence
  Synthetic
VRGGYTSGWDYFDY

SEQ ID NO: 161 - DNA, 321 bp, Artificial Sequence
  Synthetic
gacatccagttgacccagtctccatccttcctgtctgcatctgtgggagacagagtcaccatcacttgctgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatccgccgcctgcagcctgaagattttgcaagttattactgtcaacagcttaataattacccgtacacttttggccaggggaccaagctggagatcaaa

SEQ ID NO: 162 - protein, 107 aa, Artificial Sequence
  Synthetic
DIQLTQSPSFLSASVGDRVTITCWASQGISSYLAWYQQKPGKAPKLLIYAASTLQSGVPSRFSGSGSGTEFTLTIRRLQPEDFASYYCQQLNNYPYTFGQGTKLEIK

SEQ ID NO: 163 - DNA, 18 bp, Artificial Sequence
  Synthetic
cagggcattagcagttat

SEQ ID NO: 164 - protein, 6 aa, Artificial Sequence
  Synthetic
QGISSY

SEQ ID NO: 165 - DNA, 9 bp, Artificial Sequence
  Synthetic
gctgcatcc

SEQ ID NO: 166 - protein, 3 aa, Artificial Sequence
  Synthetic
AAS

SEQ ID NO: 167 - DNA, 27 bp, Artificial Sequence
  Synthetic
caacagcttaataattacccgtacact

SEQ ID NO: 168 - protein, 9 aa, Artificial Sequence
  Synthetic
QQLNNYPYT

SEQ ID NO: 169 - DNA, 381 bp, Artificial Sequence
  Synthetic
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatggggtctacagtaactacggacgatactactactactacggtatggacgtctggggccaagggaccacggtcaccgtctcctca

SEQ ID NO: 170 - protein, 127 aa, Artificial Sequence
  Synthetic
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDGVYSNYGRYYYYYGMDVWGQGTTVTVSS

SEQ ID NO: 171 - DNA, 24 bp, Artificial Sequence
  Synthetic
ggattcaccttcagtagctatggc

SEQ ID NO: 172 - protein, 8 aa, Artificial Sequence
  Synthetic
GFTFSSYG

SEQ ID NO: 173 - DNA, 24 bp, Artificial Sequence
  Synthetic
atatggtatgatggaagtaataaa

SEQ ID NO: 174 - protein, 8 aa, Artificial Sequence
  Synthetic
IWYDGSNK

SEQ ID NO: 175 - DNA, 60 bp, Artificial Sequence
  Synthetic
gcgagagatggggtctacagtaactacggacgatactactactactacggtatggacgtc

SEQ ID NO: 176 - protein, 20 aa, Artificial Sequence
  Synthetic
ARDGVYSNYGRYYYYYGMDV

SEQ ID NO: 177 - DNA, 321 bp, Artificial Sequence
  Synthetic
gacatccagatgacccagtctccatcctccctgtctgcatctgtaggagacagagtcaccatcacttgccgggcaagtcagagcatacgtagctttttaaattggtatcagcagaaaccagggaaagcccctaagttcctaatttctgctgcatccagtttgcaaagaggggtcccatctaggttcagtggcagtggatctgggacagatttcactctcaccatcagcagtctgcaacctgaggattcttcaacttactactgtcaacagagttacagtatcccggtcactttcggcggagggaccaaggtggagatcaaa

SEQ ID NO: 178 - protein, 107 aa, Artificial Sequence
  Synthetic
DIQMTQSPSSLSASVGDRVTITCRASQSIRSFLNWYQQKPGKAPKFLISAASSLQRGVPSRFSGSGSGTDFTLTISSLQPEDSSTYYCQQSYSIPVTFGGGTKVEIK

SEQ ID NO: 179 - DNA, 18 bp, Artificial Sequence
  Synthetic
cagagcatacgtagcttt

SEQ ID NO: 180 - protein, 6 aa, Artificial Sequence
  Synthetic
QSIRSF

SEQ ID NO: 181 - DNA, 9 bp, Artificial Sequence
  Synthetic
gctgcatcc

SEQ ID NO: 182 - protein, 3 aa, Artificial Sequence
  Synthetic
AAS

SEQ ID NO: 183 - DNA, 27 bp, Artificial Sequence
  Synthetic
caacagagttacagtatcccggtcact

SEQ ID NO: 184 - protein, 9 aa, Artificial Sequence
  Synthetic
QQSYSIPVT

SEQ ID NO: 185 - DNA, 372 bp, Artificial Sequence
  Synthetic
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgtagtatctgtgaaaagtcgaataatcttcaacccagacacatccaagaaccagttctccctgcagctgaactctgtgactcccgaggacacggctgtgtattactgtgcaagagtgaggcaggattatagaagtggcccgtttgactactggggccagggaaccctggtcaccgtctcctca

SEQ ID NO: 186 - protein, 124 aa, Artificial Sequence
  Synthetic
QVQLQQSGPGLVKPSQTLSLTCAISGDSVSSNSAAWNWIRQSPSRGLEWLGRTYYRSKWYNDYVVSVKSRIIFNPDTSKNQFSLQLNSVTPEDTAVYYCARVRQDYRSGPFDYWGQGTLVTVSS

SEQ ID NO: 187 - DNA, 30 bp, Artificial Sequence; identical to SEQ ID NO: 3
  Synthetic

SEQ ID NO: 188 - protein, 10 aa, Artificial Sequence
  Synthetic
GDSVSSNSAA

SEQ ID NO: 189 - DNA, 27 bp, Artificial Sequence
  Synthetic
acatactacaggtccaagtggtataat

SEQ ID NO: 190 - protein, 9 aa, Artificial Sequence
  Synthetic
TYYRSKWYN

SEQ ID NO: 191 - DNA, 42 bp, Artificial Sequence
  Synthetic
gcaagagtgaggcaggattatagaagtggcccgtttgactac

SEQ ID NO: 192 - protein, 14 aa, Artificial Sequence
  Synthetic
ARVRQDYRSGPFDY

SEQ ID NO: 193 - DNA, 321 bp, Artificial Sequence
  Synthetic
gaaatagtgatgacgcagtctccagtcaccctgtctgtgtctccaggggaaagagccaccctctcctgttgggccagtcagagtgttagcagcagcttagcctggtaccagcagaaacctggccaggctcccagactcctcatctatggtgcatccaccagggccactggtatcccagccaggttcagtggcagtgggtctgggacagggttcactctcaccatcagcagcctgcagtctgaagattttgcagtttattactgtcagcagtataataactggccattcactttcggccctgggaccaaagtggatatcaaa

SEQ ID NO: 194 - protein, 107 aa, Artificial Sequence
  Synthetic
EIVMTQSPVTLSVSPGERATLSCWASQSVSSSLAWYQQKPGQAPRLLIYGASTRATGIPARFSGSGSGTGFTLTISSLQSEDFAVYYCQQYNNWPFTFGPGTKVDIK

SEQ ID NO: 195 - DNA, 18 bp, Artificial Sequence
  Synthetic
cagagtgttagcagcagc

SEQ ID NO: 196 - protein, 6 aa, Artificial Sequence
  Synthetic
QSVSSS

SEQ ID NO: 197 - DNA, 9 bp, Artificial Sequence
  Synthetic
ggtgcatcc

SEQ ID NO: 198 - protein, 3 aa, Artificial Sequence
  Synthetic
GAS

SEQ ID NO: 199 - DNA, 27 bp, Artificial Sequence
  Synthetic
cagcagtataataactggccattcact

SEQ ID NO: 200 - protein, 9 aa, Artificial Sequence
  Synthetic
QQYNNWPFT

SEQ ID NO: 201 - DNA, 354 bp, Artificial Sequence
  Synthetic
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagttattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagcagtatagccggggctttgactactggggccagggaaccctggtcaccgtctcctca

SEQ ID NO: 202 - protein, 118 aa, Artificial Sequence
  Synthetic
EVQLLESGGGLVQPGGSLRLSCAASGFTFSSYAMSWVRQAPGKGLEWVSVISGSGGSTYYADSVKGRFTISRDNSKNTLYLQMNSLRAEDTAVYYCAKEQYSRGFDYWGQGTLVTVSS

SEQ ID NO: 203 - DNA, 24 bp, Artificial Sequence
  Synthetic
ggattcacctttagcagctatgcc

SEQ ID NO: 204 - protein, 8 aa, Artificial Sequence
  Synthetic
GFTFSSYA

SEQ ID NO: 205 - DNA, 24 bp, Artificial Sequence
  Synthetic
attagtggtagtggtggtagcaca

SEQ ID NO: 206 - protein, 8 aa, Artificial Sequence
  Synthetic
ISGSGGST

SEQ ID NO: 207 - DNA, 33 bp, Artificial Sequence
  Synthetic
gcgaaagagcagtatagccggggctttgactac

SEQ ID NO: 208 - protein, 11 aa, Artificial Sequence
  Synthetic
AKEQYSRGFDY

SEQ ID NO: 209 - DNA, 318 bp, Artificial Sequence
  Synthetic
gacatccagatgacccagtctccttccaccctgtctgtatctgtaggagacagagtcaccatcacttgccgggccagtcagagtattagtagttggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattggacgttcggccaagggaccaaggtggaaatcaaa

SEQ ID NO: 210 - protein, 106 aa, Artificial Sequence
  Synthetic
DIQMTQSPSTLSVSVGDRVTITCRASQSISSWLAWYQQKPGKAPKLLIYKASSLESGVPSRFSGSGSGTEFTLTISSLQPDDFATYYCQQYNSYWTFGQGTKVEIK

SEQ ID NO: 211 - DNA, 18 bp, Artificial Sequence
  Synthetic
cagagtattagtagttgg

SEQ ID NO: 212 - protein, 6 aa, Artificial Sequence
  Synthetic
QSISSW

SEQ ID NO: 213 - DNA, 9 bp, Artificial Sequence
  Synthetic
aaggcgtct

SEQ ID NO: 214 - protein, 3 aa, Artificial Sequence
  Synthetic
KAS

SEQ ID NO: 215 - DNA, 24 bp, Artificial Sequence
  Synthetic
caacagtataatagttattggacg

SEQ ID NO: 216 - protein, 8 aa, Artificial Sequence
  Synthetic
QQYNSYWT

SEQ ID NO: 217 - DNA, 345 bp, Artificial Sequence
  Synthetic
caggtgcagctggtggagtctgggggaggcgtggtccagcctgggaggtccctgagactctcctgtgtagcctctggattcaccatcagtagctatggcatgaactgggtccgccaggctccaggcaaggggctggagtgggtggcagttatatcatatgatggaggtaataaatactctgtagactccgtgaagggccgattcaccatctccagagacaattccaagaatacgctgtatctgcaaatgaacagcctgagagctgaggactcggctgtttattactgtgcgagaggaaggtacttcgatctctggggccgtggcaccctggtcactgtctcctca

SEQ ID NO: 218 - protein, 115 aa, Artificial Sequence
  Synthetic
QVQLVESGGGVVQPGRSLRLSCVASGFTISSYGMNWVRQAPGKGLEWVAVISYDGGNKYSVDSVKGRFTISRDNSKNTLYLQMNSLRAEDSAVYYCARGRYFDLWGRGTLVTVSS

SEQ ID NO: 219 - DNA, 24 bp, Artificial Sequence
  Synthetic
ggattcaccatcagtagctatggc

SEQ ID NO: 220 - protein, 8 aa, Artificial Sequence
  Synthetic
GFTISSYG

SEQ ID NO: 221 - DNA, 24 bp, Artificial Sequence
  Synthetic
atatcatatgatggaggtaataaa

SEQ ID NO: 222 - protein, 8 aa, Artificial Sequence
  Synthetic
ISYDGGNK

SEQ ID NO: 223 - DNA, 24 bp, Artificial Sequence
  Synthetic
gcgagaggaaggtacttcgatctc

SEQ ID NO: 224 - protein, 8 aa, Artificial Sequence
  Synthetic
ARGRYFDL

SEQ ID NO: 225 - DNA, 321 bp, Artificial Sequence
  Synthetic
gacatccagatgacccagtctccttccaccctgtctgcatctgtaggagacagagtcaccatcacttgccgggccagtcagagtattagtagctggttggcctggtatcagcagaaaccagggagagcccctaacctcctgatctctaaggcgtctagtttaaaaagtggggtcccatcaaggttcagcggcagtggatctgggacagaattcactctcaccgtcagcagcctgcagcctgatgattttgcaacttattactgccaacagtattatagttattcttacacttttggccaggggaccaagctggagatcaaa

SEQ ID NO: 226 - protein, 107 aa, Artificial Sequence
  Synthetic
DIQMTQSPSTLSASVGDRVTITCRASQSISSWLAWYQQKPGRAPNLLISKASSLKSGVPSRFSGSGSGTEFTLTVSSLQPDDFATYYCQQYYSYSYTFGQGTKLEIK

SEQ ID NO: 227 - DNA, 18 bp, Artificial Sequence
  Synthetic
cagagtattagtagctgg

SEQ ID NO: 228 - protein, 6 aa, Artificial Sequence
  Synthetic
QSISSW

SEQ ID NO: 229 - DNA, 9 bp, Artificial Sequence
  Synthetic
aaggcgtct

SEQ ID NO: 230 - protein, 3 aa, Artificial Sequence
  Synthetic
KAS

SEQ ID NO: 231 - DNA, 27 bp, Artificial Sequence
  Synthetic
caacagtattatagttattcttacact

SEQ ID NO: 232 - protein, 9 aa, Artificial Sequence
  Synthetic
QQYYSYSYT

SEQ ID NO: 233 - DNA, 360 bp, Artificial Sequence
  Synthetic
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagtcaccatatcagtagacacgtctaagaaccagttctccctgaagctgaactctgtgactgccgcggacacggccgtgtattactgtgcgagggacgacggtgactactacggtatggacgtctggggccaagggaccacggtcaccgtctcctca

SEQ ID NO: 234 - protein, 120 aa, Artificial Sequence
  Synthetic
QVQLQESGPGLVKPSQTLSLTCTVSGGSISSGGYYWSWIRQHPGKGLEWIGYIYYSGSTYYNPSLKSRVTISVDTSKNQFSLKLNSVTAADTAVYYCARDDGDYYGMDVWGQGTTVTVSS

SEQ ID NO: 235 - DNA, 30 bp, Artificial Sequence
  Synthetic
ggtggctccatcagcagtggtggttactac

SEQ ID NO: 236 - protein, 10 aa, Artificial Sequence
  Synthetic
GGSISSGGYY

SEQ ID NO: 237 - DNA, 21 bp, Artificial Sequence
  Synthetic
atctattacagtgggagcacc

SEQ ID NO: 238 - protein, 7 aa, Artificial Sequence
  Synthetic
IYYSGST

SEQ ID NO: 239 - DNA, 36 bp, Artificial Sequence
  Synthetic
gcgagggacgacggtgactactacggtatggacgtc

SEQ ID NO: 240 - protein, 12 aa, Artificial Sequence
  Synthetic
ARDDGDYYGMDV

SEQ ID NO: 241 - DNA, 324 bp, Artificial Sequence
  Synthetic
gaaattgtgttgacacagtctccagccaccctgtctttgtctccaggggaaagagccaccctctcctgcagggccagtcagactgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccattcactttcggccctgggaccaaagtggatatcaaa

SEQ ID NO: 242 - protein, 108 aa, Artificial Sequence
  Synthetic
EIVLTQSPATLSLSPGERATLSCRASQTVSSYLAWYQQKPGQAPRLLIYDASNRATGIPARFSGSGSGTDFTLTISSLEPEDFAVYYCQQRSNWPPFTFGPGTKVDIK

SEQ ID NO: 243 - DNA, 18 bp, Artificial Sequence
  Synthetic
cagactgttagcagctac

SEQ ID NO: 244 - protein, 6 aa, Artificial Sequence
  Synthetic
QTVSSY

SEQ ID NO: 245 - DNA, 9 bp, Artificial Sequence
  Synthetic
gatgcatcc

SEQ ID NO: 246 - protein, 3 aa, Artificial Sequence
  Synthetic
DAS

SEQ ID NO: 247 - DNA, 30 bp, Artificial Sequence
  Synthetic
cagcagcgtagcaactggcctccattcact

SEQ ID NO: 248 - protein, 10 aa, Artificial Sequence
  Synthetic
QQRSNWPPFT

SEQ ID NO: 249 - DNA, 399 bp, Artificial Sequence
  Synthetic
caggtacagctgcagcagtcaggtccaggactggtgaagccctcgcagaccctctcactcacctgtgccatctccggggacagtgtctctagtaatcgtgctgcttggaactggatcaggcagtccccatcgagaggccttcagtggctgggaaggacatactataggtccaagtggtataatgattatgcagtatctctgagaagtcgaataaccatcaacccagtcacatccaagaaccaggtcgccctgcatatgaactctgtgactcccgaggacacggctgtgtattactgtgcaagggcgggaattgttgtagtgccaggtccggaaactttctactattatgatcacggtttggacgtctggggccaagggaccacggtcaccgtctcctca

SEQ ID NO: 250 - protein, 133 aa, Artificial Sequence
  Synthetic
QVQLQQSGPGLVKPSQTLSLTCAISGDSVSSNRAAWNWIRQSPSRGLQWLGRTYYRSKWYNDYAVSLRSRITINPVTSKNQVALHMNSVTPEDTAVYYCARAGIVVVPGPETFYYYDHGLDVWGQGTTVTVSS

SEQ ID NO: 251 - DNA, 30 bp, Artificial Sequence
  Synthetic
ggggacagtgtctctagtaatcgtgctgct

SEQ ID NO: 252 - protein, 10 aa, Artificial Sequence
  Synthetic
GDSVSSNRAA

SEQ ID NO: 253 - DNA, 27 bp, Artificial Sequence
  Synthetic
acatactataggtccaagtggtataat

SEQ ID NO: 254 - protein, 9 aa, Artificial Sequence
  Synthetic
TYYRSKWYN

SEQ ID NO: 255 - DNA, 69 bp, Artificial Sequence
  Synthetic
gcaagggcgggaattgttgtagtgccaggtccggaaactttctactattatgatcacggtttggacgtc

SEQ ID NO: 256 - protein, 23 aa, Artificial Sequence
  Synthetic
ARAGIVVVPGPETFYYYDHGLDV

SEQ ID NO: 257 - DNA, 324 bp, Artificial Sequence
  Synthetic
gacatccagatgacccagtctccatcctccctgtctgcatctgtaggagacagagtcaccatcacttgccgggcaagtcagagcattagaagctatttaaattggtatcagcagaaaccagggaaagcccctgagctcctgatccatgctgcatccagtttgcaaagtggggtcccttcaaggttcagtggcagtggatctgggacagatttcactctcaccatcagcagtctgcaacctgaagattttgcaagttattactgtcaacagagttacagtgcccctccgatcaccttcggccaagggacacgactggagattaaa

SEQ ID NO: 258 - protein, 108 aa, Artificial Sequence
  Synthetic
DIQMTQSPSSLSASVGDRVTITCRASQSIRSYLNWYQQKPGKAPELLIHAASSLQSGVPSRFSGSGSGTDFTLTISSLQPEDFASYYCQQSYSAPPITFGQGTRLEIK

SEQ ID NO: 259 - DNA, 18 bp, Artificial Sequence
  Synthetic
cagagcattagaagctat

SEQ ID NO: 260 - protein, 6 aa, Artificial Sequence
  Synthetic
QSIRSY

SEQ ID NO: 261 - DNA, 9 bp, Artificial Sequence
  Synthetic
gctgcatcc

SEQ ID NO: 262 - protein, 3 aa, Artificial Sequence
  Synthetic
AAS

SEQ ID NO: 263 - DNA, 30 bp, Artificial Sequence
  Synthetic
caacagagttacagtgcccctccgatcacc

SEQ ID NO: 264 - protein, 10 aa, Artificial Sequence
  Synthetic
QQSYSAPPIT

SEQ ID NO: 265 - DNA, 399 bp, Artificial Sequence
  Synthetic
caggtccagctgcagcagtcaggtccaggactggtgaagccctcgcaggccctctcactcacctgtgccatctccggggacagtgtctccagcaacagtgctgcttggaactggatcaggcagtccccctcgagaggccttgagtggctgggaaggacatattataggtccaagtggtataatgattatgcagtgtctgtgaaaagtcgaataaccatcaacccagacacatccaagaaccacttctccctgcacctgaattctatgactcccgaggacacggctgtgtattactgtgcaagggcgagaattgtagtcgttccaggtccggaggtttattactactactactacgatatggacgtctggggccaagggaccacggtcaccgtctcctca

SEQ ID NO: 266 - protein, 133 aa, Artificial Sequence
  Synthetic
QVQLQQSGPGLVKPSQALSLTCAISGDSVSSNSAAWNWIRQSPSRGLEWLGRTYYRSKWYNDYAVSVKSRITINPDTSKNHFSLHLNSMTPEDTAVYYCARARIVVVPGPEVYYYYYYDMDVWGQGTTVTVSS

SEQ ID NO: 267 - DNA, 30 bp, Artificial Sequence
  Synthetic
ggggacagtgtctccagcaacagtgctgct

SEQ ID NO: 268 - protein, 10 aa, Artificial Sequence
  Synthetic
GDSVSSNSAA

SEQ ID NO: 269 - DNA, 27 bp, Artificial Sequence
  Synthetic
acatattataggtccaagtggtataat

SEQ ID NO: 270 - protein, 9 aa, Artificial Sequence
  Synthetic
TYYRSKWYN

SEQ ID NO: 271 - DNA, 69 bp, Artificial Sequence
  Synthetic
gcaagggcgagaattgtagtcgttccaggtccggaggtttattactactactactacgatatggacgtc

SEQ ID NO: 272 - protein, 23 aa, Artificial Sequence
  Synthetic
ARARIVVVPGPEVYYYYYYDMDV

SEQ ID NO: 273 - DNA, 324 bp, Artificial Sequence
  Synthetic
gacatccagatgacccagtctccatcctccctgtctgcatctgtaggagacagagtcaccatcacttgccgggcaagtcagagcattagaagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtagccctccgatcaccttcggccaagggacacgactggagattaaa

SEQ ID NO: 274 - protein, 108 aa, Artificial Sequence
  Synthetic
DIQMTQSPSSLSASVGDRVTITCRASQSIRSYLNWYQQKPGKAPKLLIYAASSLQSGVPSRFSGSGSGTDFTLTISSLQPEDFATYYCQQSYSSPPITFGQGTRLEIK

SEQ ID NO: 275 - DNA, 18 bp, Artificial Sequence
  Synthetic
cagagcattagaagctat

SEQ ID NO: 276 - protein, 6 aa, Artificial Sequence
  Synthetic
QSIRSY

SEQ ID NO: 277 - DNA, 9 bp, Artificial Sequence
  Synthetic
gctgcatcc

SEQ ID NO: 278 - protein, 3 aa, Artificial Sequence
  Synthetic
AAS

SEQ ID NO: 279 - DNA, 30 bp, Artificial Sequence
  Synthetic
caacagagttacagtagccctccgatcacc

SEQ ID NO: 280 - protein, 10 aa, Artificial Sequence
  Synthetic
QQSYSSPPIT

SEQ ID NO: 281 - DNA, 399 bp, Artificial Sequence
  Synthetic
caggtacagctgcagcagtcaggtccaggactggtgaagccctcgcagaccctctcactcacctgtgtcatctccggggacagtgtctctactaatagtgctgcttggaactggatcaggcagtccccatcgagaggccttgagtggctgggaaggacatattataggtccaagtggtataatgattatgcagtatctgtgagaagtcgaataaccatcaacccagtcacatccaagaaccaggtcgccctgcatctgaactctgtgactcccgaggacacggctgtgtattactgtgcaagggcgggaattgttgtggtgccaggtccggaaacttattactattattatcacggtttggacgtctggggccaagggaccacggtcaccgtctcctca

SEQ ID NO: 282 - protein, 133 aa, Artificial Sequence
  Synthetic
QVQLQQSGPGLVKPSQTLSLTCVISGDSVSTNSAAWNWIRQSPSRGLEWLGRTYYRSKWYNDYAVSVRSRITINPVTSKNQVALHLNSVTPEDTAVYYCARAGIVVVPGPETYYYYYHGLDVWGQGTTVTVSS

SEQ ID NO: 283 - DNA, 30 bp, Artificial Sequence
  Synthetic
ggggacagtgtctctactaatagtgctgct

SEQ ID NO: 284 - protein, 10 aa, Artificial Sequence
  Synthetic
GDSVSTNSAA

SEQ ID NO: 285 - DNA, 27 bp, Artificial Sequence
  Synthetic
acatattataggtccaagtggtataat

SEQ ID NO: 286 - protein, 9 aa, Artificial Sequence
  Synthetic
TYYRSKWYN

SEQ ID NO: 287 - DNA, 69 bp, Artificial Sequence
  Synthetic
gcaagggcgggaattgttgtggtgccaggtccggaaacttattactattattatcacggtttggacgtc

SEQ ID NO: 288 - protein, 23 aa, Artificial Sequence
  Synthetic
ARAGIVVVPGPETYYYYYHGLDV

SEQ ID NO: 289 - DNA, 324 bp, Artificial Sequence
  Synthetic
gacatccagatgacccagtctccatcctccctgtctgcatctgtaggagacagagtcaccatcacttgccgggcaagtcagaacattagaagctatttaaattggtatcagcagaaaccagggaaagcccctaagctcctgatccatgttgcatccagtttgcaaagtggggtcccatcaaggttcagtggcagtggatctgggacagatttcactctcaccatcagcagtctgcaacctgaagattttgcaacttactactgtcaacagagttacagtacccctccgatcaccttcggccacgggacacgactggaaattaaa

SEQ ID NO: 290 - protein, 108 aa, Artificial Sequence
  Synthetic
DIQMTQSPSSLSASVGDRVTITCRASQNIRSYLNWYQQKPGKAPKLLIHVASSLQSGVPSRFSGSGSGTDFTLTISSLQPEDFATYYCQQSYSTPPITFGHGTRLEIK

SEQ ID NO: 291 - DNA, 18 bp, Artificial Sequence
  Synthetic
cagaacattagaagctat

SEQ ID NO: 292 - protein, 6 aa, Artificial Sequence
  Synthetic
QNIRSY

SEQ ID NO: 293 - DNA, 9 bp, Artificial Sequence
  Synthetic
gttgcatcc

SEQ ID NO: 294 - protein, 3 aa, Artificial Sequence
  Synthetic
VAS

SEQ ID NO: 295 - DNA, 30 bp, Artificial Sequence; identical to SEQ ID NO: 15
  Synthetic

SEQ ID NO: 296 - protein, 10 aa, Artificial Sequence
  Synthetic
QQSYSTPPIT

SEQ ID NO: 297 - DNA, 348 bp, Artificial Sequence
  Synthetic
cagctgcagctgcaggagtcgggcccaggactggtgaagccttcggagaccctgtccctcacctgcactgtctctggtggctccctcagcagtaatagttactactggggctggatccgccagcccccagggaaggggctggagtggattgggagtatctattatagtgggagcacctactacaacccgtccctcaagagtcgagtcaccatatccgtagacacgtcccagaaccagttctccctgaagctgagctctgtgaccgccgcagacacggctgtgtattactgtgcgagacagaactactttgactactggggccagggaaccctggtcaccgtctcctca

SEQ ID NO: 298 - protein, 116 aa, Artificial Sequence
  Synthetic
QLQLQESGPGLVKPSETLSLTCTVSGGSLSSNSYYWGWIRQPPGKGLEWIGSIYYSGSTYYNPSLKSRVTISVDTSQNQFSLKLSSVTAADTAVYYCARQNYFDYWGQGTLVTVSS

SEQ ID NO: 299 - DNA, 30 bp, Artificial Sequence
  Synthetic
ggtggctccctcagcagtaatagttactac

SEQ ID NO: 300 - protein, 10 aa, Artificial Sequence
  Synthetic
GGSLSSNSYY

SEQ ID NO: 301 - DNA, 21 bp, Artificial Sequence
  Synthetic
atctattatagtgggagcacc

SEQ ID NO: 302 - protein, 7 aa, Artificial Sequence
  Synthetic
IYYSGST

SEQ ID NO: 303 - DNA, 24 bp, Artificial Sequence
  Synthetic
gcgagacagaactactttgactac

SEQ ID NO: 304 - protein, 8 aa, Artificial Sequence
  Synthetic
ARQNYFDY

SEQ ID NO: 305 - DNA, 321 bp, Artificial Sequence
  Synthetic
gacatccagttgacccagtctccatccttcctgtctgcatctgtaggagacagagtcaccatcacttgctgggccagtcagggcattagcaggtatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttatcctctcactttcggccctgggaccaaactggatatcaaa

SEQ ID NO: 306 - protein, 107 aa, Artificial Sequence
  Synthetic
DIQLTQSPSFLSASVGDRVTITCWASQGISRYLAWYQQKPGKAPKLLIYAASTLQSGVPSRFSGSGSGTEFTLTISSLQPEDFATYYCQQLNSYPLTFGPGTKLDIK

SEQ ID NO: 307 - DNA, 18 bp, Artificial Sequence
  Synthetic
cagggcattagcaggtat

SEQ ID NO: 308 - protein, 6 aa, Artificial Sequence
  Synthetic
QGISRY

SEQ ID NO: 309 - DNA, 9 bp, Artificial Sequence
  Synthetic
gctgcatcc

SEQ ID NO: 310 - protein, 3 aa, Artificial Sequence
  Synthetic
AAS

SEQ ID NO: 311 - DNA, 27 bp, Artificial Sequence
  Synthetic
caacagcttaatagttatcctctcact

SEQ ID NO: 312 - protein, 9 aa, Artificial Sequence
  Synthetic
QQLNSYPLT

SEQ ID NO: 313 - DNA, 345 bp, Artificial Sequence
  Synthetic
caggtgcagctggtggagtctgggggaggcgtggtccagcctgggaggtccctgagactctcctgtgcagtctctggattcacctccagtacctatggcatgaactgggtccgccaggctccaggcaaggggctggagtgggtggcagttatatcatatgatggaagtaataaatactacgcagactccgtgaagggccgattcaccatctccagggacaattccaagaacacgctgtatctgcaaatgaacagcctgagacctgaggacacggctgtgtattactgtgcgagaggaaggtacttcgatctctggggccgtggcaccctggtcactgtctcctca

SEQ ID NO: 314 - protein, 115 aa, Artificial Sequence
  Synthetic
QVQLVESGGGVVQPGRSLRLSCAVSGFTSSTYGMNWVRQAPGKGLEWVAVISYDGSNKYYADSVKGRFTISRDNSKNTLYLQMNSLRPEDTAVYYCARGRYFDLWGRGTLVTVSS

SEQ ID NO: 315 - DNA, 24 bp, Artificial Sequence
  Synthetic
ggattcacctccagtacctatggc

SEQ ID NO: 316 - protein, 8 aa, Artificial Sequence
  Synthetic
GFTSSTYG

SEQ ID NO: 317 - DNA, 24 bp, Artificial Sequence
  Synthetic
atatcatatgatggaagtaataaa

SEQ ID NO: 318 - protein, 8 aa, Artificial Sequence
  Synthetic
ISYDGSNK

SEQ ID NO: 319 - DNA, 24 bp, Artificial Sequence
  Synthetic
gcgagaggaaggtacttcgatctc

SEQ ID NO: 320 - protein, 8 aa, Artificial Sequence
  Synthetic
ARGRYFDL

SEQ ID NO: 321 - DNA, 321 bp, Artificial Sequence
  Synthetic
gacatccagatgacccagtctccttccaccctgtctgcatctgtaggagacagagtcaccatcacttgccgggccagtcaaattattagtagctggttggcctggtatcagcagaaaccagggaaagcccctaaactcctgatctataaggcgtctagtttagcaagtggggtcccatcaaggttcagcggcagtggatctgggacagaattcactctcaccatcagcagcctgcagcctgatgattttgcaacttattactgccaacagtataaaagttattcttacacctttggccaggggaccaacctggagatcaaa

SEQ ID NO: 322 - protein, 107 aa, Artificial Sequence
  Synthetic
DIQMTQSPSTLSASVGDRVTITCRASQIISSWLAWYQQKPGKAPKLLIYKASSLASGVPSRFSGSGSGTEFTLTISSLQPDDFATYYCQQYKSYSYTFGQGTNLEIK

SEQ ID NO: 323 - DNA, 18 bp, Artificial Sequence
  Synthetic
caaattattagtagctgg

SEQ ID NO: 324 - protein, 6 aa, Artificial Sequence
  Synthetic
QIISSW

SEQ ID NO: 325 - DNA, 9 bp, Artificial Sequence
  Synthetic
aaggcgtct

SEQ ID NO: 326 - protein, 3 aa, Artificial Sequence
  Synthetic
KAS

SEQ ID NO: 327 - DNA, 27 bp, Artificial Sequence
  Synthetic
caacagtataaaagttattcttacacc

SEQ ID NO: 328 - protein, 9 aa, Artificial Sequence
  Synthetic
QQYKSYSYT

SEQ ID NO: 329 - DNA, 378 bp, Artificial Sequence
  Synthetic
caggtgcagctggtggagtctgggggaggcgtggtccagcctgggaggtccctgggactctcctgtgcagcgtctggattcaccttcagtagctatggcatgcactgggtccgccaggctccaggcaaggggctggagtgggtggcagttatatggtatgatggaagtaataaatactatgtagactccgtgaagggccgattcaccatctccagagacaattccaagaacacgctgtatctgcaaatgaacagcctgagagccgaggacacggctgtgtattactgtgcgagagaggggctacgatttttggagaattactactactactacggtatggacgtctggggccaagggaccacggtcaccgtctcctca

SEQ ID NO: 330 - protein, 126 aa, Artificial Sequence
  Synthetic
QVQLVESGGGVVQPGRSLGLSCAASGFTFSSYGMHWVRQAPGKGLEWVAVIWYDGSNKYYVDSVKGRFTISRDNSKNTLYLQMNSLRAEDTAVYYCAREGLRFLENYYYYYGMDVWGQGTTVTVSS

SEQ ID NO: 331 - DNA, 24 bp, Artificial Sequence
  Synthetic
ggattcaccttcagtagctatggc

SEQ ID NO: 332 - protein, 8 aa, Artificial Sequence
  Synthetic
GFTFSSYG

SEQ ID NO: 333 - DNA, 24 bp, Artificial Sequence
  Synthetic
atatggtatgatggaagtaataaa

SEQ ID NO: 334 - protein, 8 aa, Artificial Sequence
  Synthetic
IWYDGSNK

SEQ ID NO: 335 - DNA, 57 bp, Artificial Sequence
  Synthetic
gcgagagaggggctacgatttttggagaattactactactactacggtatggacgtc

SEQ ID NO: 336 - protein, 19 aa, Artificial Sequence
  Synthetic
AREGLRFLENYYYYYGMDV

SEQ ID NO: 337 - DNA, 324 bp, Artificial Sequence
  Synthetic
gaaattgtgttgacgcagtctccaggcaccctgtctttgtctccaggggaaagagccaccctctcctgcagggccagtcagagtattagcagcacctacttagcctggtaccagcagagacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtacctcaccgtacacttttggccaggggaccaagctggagatcaaa

SEQ ID NO: 338 - protein, 108 aa, Artificial Sequence
  Synthetic
EIVLTQSPGTLSLSPGERATLSCRASQSISSTYLAWYQQRPGQAPRLLIYGASSRATGIPDRFSGSGSGTDFTLTISRLEPEDFAVYYCQQYGTSPYTFGQGTKLEIK

SEQ ID NO: 339 - DNA, 21 bp, Artificial Sequence
  Synthetic
cagagtattagcagcacctac

SEQ ID NO: 340 - protein, 7 aa, Artificial Sequence
  Synthetic
QSISSTY

SEQ ID NO: 341 - DNA, 9 bp, Artificial Sequence
  Synthetic
ggtgcatcc

SEQ ID NO: 342 - protein, 3 aa, Artificial Sequence
  Synthetic
GAS

SEQ ID NO: 343 - DNA, 27 bp, Artificial Sequence
  Synthetic
cagcagtatggtacctcaccgtacact

SEQ ID NO: 344 - protein, 9 aa, Artificial Sequence
  Synthetic
QQYGTSPYT

SEQ ID NO: 345 - DNA, 345 bp, Artificial Sequence; identical to SEQ ID NO: 313
  Synthetic

SEQ ID NO: 346 - protein, 115 aa, Artificial Sequence; identical to SEQ ID NO: 314
  Synthetic

SEQ ID NO: 347 - DNA, 24 bp, Artificial Sequence
  Synthetic
ggattcacctccagtacctatggc

SEQ ID NO: 348 - protein, 8 aa, Artificial Sequence
  Synthetic
GFTSSTYG

SEQ ID NO: 349 - DNA, 24 bp, Artificial Sequence
  Synthetic
atatcatatgatggaagtaataaa

SEQ ID NO: 350 - protein, 8 aa, Artificial Sequence
  Synthetic
ISYDGSNK

SEQ ID NO: 351 - DNA, 24 bp, Artificial Sequence
  Synthetic
gcgagaggaaggtacttcgatctc

SEQ ID NO: 352 - protein, 8 aa, Artificial Sequence
  Synthetic
ARGRYFDL

SEQ ID NO: 353 - DNA, 321 bp, Artificial Sequence
  Synthetic
gacatccagatgacccagtctccttccaccctgtctgcatctgtaggagacagagtcaccatcacttgccgggccagtcaaattattagtagctggttggcctggtatcagcagaaaccagggaaagcccctaaactcctgatctataaggcgtctagtttagcaagtggggtcccatcaaggttcagcggcagtggatctgggacagaattcactctcaccatcagcagcctgcagcctgatgattttgcaacttattactgccaacagtataaaagttattcttacacctttggccaggggaccaagctggagatcaaa

SEQ ID NO: 354 - protein, 107 aa, Artificial Sequence
  Synthetic
DIQMTQSPSTLSASVGDRVTITCRASQIISSWLAWYQQKPGKAPKLLIYKASSLASGVPSRFSGSGSGTEFTLTISSLQPDDFATYYCQQYKSYSYTFGQGTKLEIK

SEQ ID NO: 355 - DNA, 18 bp, Artificial Sequence
  Synthetic
caaattattagtagctgg

SEQ ID NO: 356 - protein, 6 aa, Artificial Sequence
  Synthetic
QIISSW

SEQ ID NO: 357 - DNA, 9 bp, Artificial Sequence
  Synthetic
aaggcgtct

SEQ ID NO: 358 - protein, 3 aa, Artificial Sequence
  Synthetic
KAS

SEQ ID NO: 359 - DNA, 27 bp, Artificial Sequence
  Synthetic
caacagtataaaagttattcttacacc

SEQ ID NO: 360 - protein, 9 aa, Artificial Sequence
  Synthetic
QQYKSYSYT

SEQ ID NO: 361 - DNA, 345 bp, Artificial Sequence
  Synthetic
caggtgcagctggtggagtctgggggaggcgtggtccagcctgggaggtccctgagactctcctgtgcagtctctggattcacctccagtacctatggcatgaactgggtccgccaggctccaggcaaggggctggagtgggtggcagttatatcatttgatggaagtaataaatactacgcagactccgtgaagggccgattcaccatctccagggacaattccaagaacacgctgtatctgcaaatgagcagcctgagacctgaggacacggctgtgtattactgtgcgagaggaaggtacttcgatctctggggccgtggcaccctggtcactgtctcctca

SEQ ID NO: 362 - protein, 115 aa, Artificial Sequence
  Synthetic
QVQLVESGGGVVQPGRSLRLSCAVSGFTSSTYGMNWVRQAPGKGLEWVAVISFDGSNKYYADSVKGRFTISRDNSKNTLYLQMSSLRPEDTAVYYCARGRYFDLWGRGTLVTVSS

SEQ ID NO: 363 - DNA, 24 bp, Artificial Sequence
  Synthetic
ggattcacctccagtacctatggc

SEQ ID NO: 364 - protein, 8 aa, Artificial Sequence
  Synthetic
GFTSSTYG

SEQ ID NO: 365 - DNA, 24 bp, Artificial Sequence
  Synthetic
atatcatttgatggaagtaataaa

SEQ ID NO: 366 - protein, 8 aa, Artificial Sequence
  Synthetic
ISFDGSNK

SEQ ID NO: 367 - DNA, 24 bp, Artificial Sequence
  Synthetic
gcgagaggaaggtacttcgatctc

SEQ ID NO: 368 - protein, 8 aa, Artificial Sequence
  Synthetic
ARGRYFDL

SEQ ID NO: 369 - DNA, 321 bp, Artificial Sequence
  Synthetic
gacacccagatgacccagtctccttccaccctgtctgcatctgtaggagacagagtcaccatcacttgccgggccagtcaaattattagtagctggttggcctggtatcagcagaaaccagggaaagcccctaaactcctgatctataaggcgtctagtttagcaagtggggtcccatcaaggttcagcggcagtggatctgggacagaattcactctcaccatcagcagcctgcagcctgatgattttgcaacttattactgccaacagtataaaagttattcttacacctttggccaggggaccaacctggagatcaaa

SEQ ID NO: 370 - protein, 107 aa, Artificial Sequence
  Synthetic
DTQMTQSPSTLSASVGDRVTITCRASQIISSWLAWYQQKPGKAPKLLIYKASSLASGVPSRFSGSGSGTEFTLTISSLQPDDFATYYCQQYKSYSYTFGQGTNLEIK

SEQ ID NO: 371 - DNA, 18 bp, Artificial Sequence
  Synthetic
caaattattagtagctgg

SEQ ID NO: 372 - protein, 6 aa, Artificial Sequence
  Synthetic
QIISSW

SEQ ID NO: 373 - DNA, 9 bp, Artificial Sequence
  Synthetic
aaggcgtct

SEQ ID NO: 374 - protein, 3 aa, Artificial Sequence
  Synthetic
KAS

SEQ ID NO: 375 - DNA, 27 bp, Artificial Sequence
  Synthetic
caacagtataaaagttattcttacacc

SEQ ID NO: 376 - protein, 9 aa, Artificial Sequence
  Synthetic
QQYKSYSYT

SEQ ID NO: 377 - DNA, 345 bp, Artificial Sequence; identical to SEQ ID NO: 361
  Synthetic

SEQ ID NO: 378 - protein, 115 aa, Artificial Sequence; identical to SEQ ID NO: 362
  Synthetic

SEQ ID NO: 379 - DNA, 24 bp, Artificial Sequence
  Synthetic
ggattcacctccagtacctatggc

SEQ ID NO: 380 - protein, 8 aa, Artificial Sequence
  Synthetic
GFTSSTYG

SEQ ID NO: 381 - DNA, 24 bp, Artificial Sequence
  Synthetic
atatcatttgatggaagtaataaa

SEQ ID NO: 382 - protein, 8 aa, Artificial Sequence
  Synthetic
ISFDGSNK

SEQ ID NO: 383 - DNA, 24 bp, Artificial Sequence
  Synthetic
gcgagaggaaggtacttcgatctc

SEQ ID NO: 384 - protein, 8 aa, Artificial Sequence
  Synthetic
ARGRYFDL

SEQ ID NO: 385 - DNA, 321 bp, Artificial Sequence; identical to SEQ ID NO: 369
  Synthetic

SEQ ID NO: 386 - protein, 107 aa, Artificial Sequence; identical to SEQ ID NO: 370
  Synthetic

SEQ ID NO: 387 - DNA, 18 bp, Artificial Sequence
  Synthetic
caaattattagtagctgg

SEQ ID NO: 388 - protein, 6 aa, Artificial Sequence
  Synthetic
QIISSW

SEQ ID NO: 389 - DNA, 9 bp, Artificial Sequence
  Synthetic
aaggcgtct

SEQ ID NO: 390 - protein, 3 aa, Artificial Sequence
  Synthetic
KAS

SEQ ID NO: 391 - DNA, 27 bp, Artificial Sequence
  Synthetic
caacagtataaaagttattcttacacc

SEQ ID NO: 392 - protein, 9 aa, Artificial Sequence
  Synthetic
QQYKSYSYT

SEQ ID NO: 393-400 - skipped (8 entries)

SEQ ID NO: 401 - DNA, 369 bp, Artificial Sequence
  synthetic
gaagtgcaactggtggagtctgggggaggcttagtacagcctggcgggtccctgagactctcctgtgcagccactggattcacctttgatgattttaccatgcactgggtccggcaagctccagggaagggcctggagtgggtctcaggtatcagttggaatagtggtagcataggctatgtggactctgtgaagggccgattcaccatctccagagacaacgccaagaactccctgtatctgcaaatgaacagtctgagagctgaggacacggccttgtactactgtgcaaaagataatagtggctacggctattattactacggtatggacgtctggggccaagggaccacggtcaccgtctcctca

SEQ ID NO: 402 - protein, 123 aa, Artificial Sequence
  synthetic
EVQLVESGGGLVQPGGSLRLSCAATGFTFDDFTMHWVRQAPGKGLEWVSGISWNSGSIGYVDSVKGRFTISRDNAKNSLYLQMNSLRAEDTALYYCAKDNSGYGYYYYGMDVWGQGTTVTVSS

SEQ ID NO: 403 - DNA, 24 bp, Artificial Sequence
  synthetic
ggattcacctttgatgattttacc

SEQ ID NO: 404 - protein, 8 aa, Artificial Sequence
  synthetic
GFTFDDFT

SEQ ID NO: 405 - DNA, 24 bp, Artificial Sequence
  synthetic
atcagttggaatagtggtagcata

SEQ ID NO: 406 - protein, 8 aa, Artificial Sequence
  synthetic
ISWNSGSI

SEQ ID NO: 407 - DNA, 48 bp, Artificial Sequence
  synthetic
gcaaaagataatagtggctacggctattattactacggtatggacgtc

SEQ ID NO: 408 - protein, 16 aa, Artificial Sequence
  synthetic
AKDNSGYGYYYYGMDV

SEQ ID NO: 409 - DNA, 321 bp, Artificial Sequence
  synthetic
gaaatagtgatgacgcagtctccagccaccctgtctgtgtctccaggggaaagagccaccctctcctgcagggccagtcacagtgttagcaggaactcagcctggtaccagcagaaacctggccaggctcccaggctcctcatctatggtgcatccaccagggccactggtatcccagccaggttcagtggcagtgggtctgggacagaattcactctcaccatcagcagcctgcagtctgaagattttgcaatttattactgtcagcagtataataattggcctctcactttcggcggagggaccaaggtggagatcaaa

SEQ ID NO: 410 - protein, 107 aa, Artificial Sequence
  synthetic
EIVMTQSPATLSVSPGERATLSCRASHSVSRNSAWYQQKPGQAPRLLIYGASTRATGIPARFSGSGSGTEFTLTISSLQSEDFAIYYCQQYNNWPLTFGGGTKVEIK

SEQ ID NO: 411 - DNA, 18 bp, Artificial Sequence
  synthetic
cacagtgttagcaggaac

SEQ ID NO: 412 - protein, 6 aa, Artificial Sequence
  synthetic
HSVSRN

SEQ ID NO: 413 - DNA, 9 bp, Artificial Sequence
  synthetic
ggtgcatcc

SEQ ID NO: 414 - protein, 3 aa, Artificial Sequence
  synthetic
GAS

SEQ ID NO: 415 - DNA, 27 bp, Artificial Sequence
  synthetic
cagcagtataataattggcctctcact

SEQ ID NO: 416 - protein, 9 aa, Artificial Sequence
  synthetic
QQYNNWPLT

SEQ ID NO: 417 - DNA, 372 bp, Artificial Sequence
  synthetic
gaagtgcaactggtggaatcggggggaggcttggtacagcctggcgggtccctgagactctcctgtgcagcctctggattctcctttgatgattataccatgcactgggtccggcaacctccagggaagggcctggagtgggtctcaggtattagttggaatagtggtagcataggctatgcggactctgtgaagggccgattcaccatctccagagacaacgccaagaactccctgtatctgcaaatgaacagtctgagagctggggacacggccttgtactactgtgcaaaagataatagtggctacggctattactactactacggtatggacgtctggggccaagggaccacggtcaccgtctcctca

SEQ ID NO: 418 - protein, 124 aa, Artificial Sequence
  synthetic
EVQLVESGGGLVQPGGSLRLSCAASGFSFDDYTMHWVRQPPGKGLEWVSGISWNSGSIGYADSVKGRFTISRDNAKNSLYLQMNSLRAGDTALYYCAKDNSGYGYYYYYGMDVWGQGTTVTVSS

SEQ ID NO: 419 - DNA, 24 bp, Artificial Sequence
  synthetic
ggattctcctttgatgattatacc

SEQ ID NO: 420 - protein, 8 aa, Artificial Sequence
  synthetic
GFSFDDYT

SEQ ID NO: 421 - DNA, 24 bp, Artificial Sequence
  synthetic
attagttggaatagtggtagcata

SEQ ID NO: 422 - protein, 8 aa, Artificial Sequence
  synthetic
ISWNSGSI

SEQ ID NO: 423 - DNA, 51 bp, Artificial Sequence
  synthetic
gcaaaagataatagtggctacggctattactactactacggtatggacgtc

SEQ ID NO: 424 - protein, 17 aa, Artificial Sequence
  synthetic
AKDNSGYGYYYYYGMDV

SEQ ID NO: 425 - DNA, 321 bp, Artificial Sequence
  synthetic
gaaatagtgatgacgcagtctccagccaccctgtctgtgtctccaggggaaagagccaccctctcctgcagggccagtcagagtgttagcagcaacttagcctggtaccagcagaaacctggccaggctcccagactcctcatctatggtgcatccaccagggccactggtatcccagccaggttcagtggcagtgggtctgggacagaattcactctcaccatcagcagcctgcagtctgaagattttgcagtttattactgtcagcagtattataactggcctctcactttcggcggagggaccaaggtggagatcaaa

SEQ ID NO: 426 - protein, 107 aa, Artificial Sequence
  synthetic
EIVMTQSPATLSVSPGERATLSCRASQSVSSNLAWYQQKPGQAPRLLIYGASTRATGIPARFSGSGSGTEFTLTISSLQSEDFAVYYCQQYYNWPLTFGGGTKVEIK

SEQ ID NO: 427 - DNA, 18 bp, Artificial Sequence
  synthetic
cagagtgttagcagcaac

SEQ ID NO: 428 - protein, 6 aa, Artificial Sequence
  synthetic
QSVSSN

SEQ ID NO: 429 - DNA, 9 bp, Artificial Sequence
  synthetic
ggtgcatcc

SEQ ID NO: 430 - protein, 3 aa, Artificial Sequence
  synthetic
GAS

SEQ ID NO: 431 - DNA, 27 bp, Artificial Sequence
  synthetic
cagcagtattataactggcctctcact

SEQ ID NO: 432 - protein, 9 aa, Artificial Sequence
  synthetic
QQYYNWPLT

SEQ ID NO: 433 - DNA, 372 bp, Artificial Sequence
  synthetic
gaagtacagctggtggagtctgggggaggcttggtacagcctggcaggtccctgagactctcctgtgtagcctctggattcccctttgctgattataccatgcactgggtccggcaagctccagggaagggcctggagtgggtctcagatattagttggaatagtggtagcaaaggctatgcggactctgtgaagggccgattcaccatctccagagacaatgccaagaactccctgtatctgcaaatgaacagtctgagaactgaggacacggccttctattactgtgcaaaagatatgagtggctacgcccactacttctactacggtatggacgtctggggccaagggaccacggtcaccgtctcctca

SEQ ID NO: 434 - protein, 124 aa, Artificial Sequence
  synthetic
EVQLVESGGGLVQPGRSLRLSCVASGFPFADYTMHWVRQAPGKGLEWVSDISWNSGSKGYADSVKGRFTISRDNAKNSLYLQMNSLRTEDTAFYYCAKDMSGYAHYFYYGMDVWGQGTTVTVSS

SEQ ID NO: 435 - DNA, 24 bp, Artificial Sequence
  synthetic
ggattcccctttgctgattatacc

SEQ ID NO: 436 - protein, 8 aa, Artificial Sequence
  synthetic
GFPFADYT

SEQ ID NO: 437 - DNA, 24 bp, Artificial Sequence
  synthetic
attagttggaatagtggtagcaaa

SEQ ID NO: 438 - protein, 8 aa, Artificial Sequence
  synthetic
ISWNSGSK

SEQ ID NO: 439 - DNA, 51 bp, Artificial Sequence
  synthetic
gcaaaagatatgagtggctacgcccactacttctactacggtatggacgtc

SEQ ID NO: 440 - protein, 17 aa, Artificial Sequence
  synthetic
AKDMSGYAHYFYYGMDV

SEQ ID NO: 441 - DNA, 324 bp, Artificial Sequence
  synthetic
gacatccagatgacccagtctccatcctccctgtctgcatctgtaggagacagagtcaccatcacttgccggccaagtcagagcattagcagctatttaaattggtttcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 442 - protein, 108 aa, Artificial Sequence
  synthetic
DIQMTQSPSSLSASVGDRVTITCRPSQSISSYLNWFQQKPGKAPKLLIYAASSLQSGVPSRFSGSGSGTDFTLTISSLQPEDFATYYCQQSYSTPPITFGQGTRLEIK

SEQ ID NO: 443 - DNA, 18 bp, Artificial Sequence
  synthetic
cagagcattagcagctat

SEQ ID NO: 444 - protein, 6 aa, Artificial Sequence
  synthetic
QSISSY

SEQ ID NO: 445 - DNA, 9 bp, Artificial Sequence
  synthetic
gctgcatcc

SEQ ID NO: 446 - protein, 3 aa, Artificial Sequence
  synthetic
AAS

SEQ ID NO: 447 - DNA, 30 bp, Artificial Sequence; identical to SEQ ID NO: 15
  synthetic

SEQ ID NO: 448 - protein, 10 aa, Artificial Sequence
  synthetic
QQSYSTPPIT

SEQ ID NO: 449 - DNA, 372 bp, Artificial Sequence
  synthetic
gaagtacaactggtggagtctgggggaggcttggtacagcctggcaggtccctaagactctcctgtgcagcctctggattcacctttgatgattataccatgcactgggtccggcaagttccagggaagggcctggagtgggtctcaggtattagttggaatagtggcagcttggcctacgcggactctgtgaagggccgattcaccatctccagagacaacgccaagaattccctgtatctgcaaatgaacagtcttcaccctgaggacacggccctctattactgtgtaaaagatggtagtggctacggccactactcctactacggtttggacgtctggggccaggggaccacggtcaccgtctcctca

SEQ ID NO: 450 - protein, 124 aa, Artificial Sequence
  synthetic
EVQLVESGGGLVQPGRSLRLSCAASGFTFDDYTMHWVRQVPGKGLEWVSGISWNSGSLAYADSVKGRFTISRDNAKNSLYLQMNSLHPEDTALYYCVKDGSGYGHYSYYGLDVWGQGTTVTVSS

SEQ ID NO: 451 - DNA, 24 bp, Artificial Sequence
  synthetic
ggattcacctttgatgattatacc

SEQ ID NO: 452 - protein, 8 aa, Artificial Sequence
  synthetic
GFTFDDYT

SEQ ID NO: 453 - DNA, 24 bp, Artificial Sequence
  synthetic
attagttggaatagtggcagcttg

SEQ ID NO: 454 - protein, 8 aa, Artificial Sequence
  synthetic
ISWNSGSL

SEQ ID NO: 455 - DNA, 51 bp, Artificial Sequence
  synthetic
gtaaaagatggtagtggctacggccactactcctactacggtttggacgtc

SEQ ID NO: 456 - protein, 17 aa, Artificial Sequence
  synthetic
VKDGSGYGHYSYYGLDV

SEQ ID NO: 457 - DNA, 324 bp, Artificial Sequence
  synthetic
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagttcaccttggacgttcggccaagggaccaaggtggaaatcaaa

SEQ ID NO: 458 - protein, 108 aa, Artificial Sequence; identical to SEQ ID NO: 114
  synthetic

SEQ ID NO: 459 - DNA, 21 bp, Artificial Sequence
  synthetic
cagagtgttagcagcagctac

SEQ ID NO: 460 - protein, 7 aa, Artificial Sequence
  synthetic
QSVSSSY

SEQ ID NO: 461 - DNA, 9 bp, Artificial Sequence
  synthetic
ggtgcatcc

SEQ ID NO: 462 - protein, 3 aa, Artificial Sequence
  synthetic
GAS

SEQ ID NO: 463 - DNA, 27 bp, Artificial Sequence
  synthetic
cagcagtatggtagttcaccttggacg

SEQ ID NO: 464 - protein, 9 aa, Artificial Sequence
  synthetic
QQYGSSPWT

SEQ ID NO: 465 - DNA, 372 bp, Artificial Sequence
  synthetic
gaagtacagctggtggagtctgggggaggcttggtacagcctggcaggtccctgagactctcctgtgtagcctctggattcccctttgctgattataccatgcactgggtccggcaagctccagggaagggcctggagtgggtctcagatattagttggaatagtggtagcataggctatgcggactctgtgaagggccgattcaccatctccagagacaatgccaagaactccctgtatctgcaaatgaacagtctgagaactgaggacacggccttgtattactgtgcaaaagatatgagtggctacgcccactacttctactacggtatggacgtctggggccaagggaccacggtcaccgtctcctca

SEQ ID NO: 466 - protein, 124 aa, Artificial Sequence
  synthetic
EVQLVESGGGLVQPGRSLRLSCVASGFPFADYTMHWVRQAPGKGLEWVSDISWNSGSIGYADSVKGRFTISRDNAKNSLYLQMNSLRTEDTALYYCAKDMSGYAHYFYYGMDVWGQGTTVTVSS

SEQ ID NO: 467 - DNA, 24 bp, Artificial Sequence
  synthetic
ggattcccctttgctgattatacc

SEQ ID NO: 468 - protein, 8 aa, Artificial Sequence
  synthetic
GFPFADYT

SEQ ID NO: 469 - DNA, 24 bp, Artificial Sequence
  synthetic
attagttggaatagtggtagcata

SEQ ID NO: 470 - protein, 8 aa, Artificial Sequence
  synthetic
ISWNSGSI

SEQ ID NO: 471 - DNA, 51 bp, Artificial Sequence; identical to SEQ ID NO: 439
  synthetic

SEQ ID NO: 472 - protein, 17 aa, Artificial Sequence
  synthetic
AKDMSGYAHYFYYGMDV

SEQ ID NO: 473 - DNA, 324 bp, Artificial Sequence
  synthetic
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccatcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 474 - protein, 108 aa, Artificial Sequence
  synthetic
DIQMTQSPSSLSASVGDRVTITCRASQSISSYLNWYQQKPGKAPKLLIFAASSLQSGVPSRFSGSGSGTDFTLTISSLQPEDFATYYCQQSYSTPPITFGQGTRLEIK

SEQ ID NO: 475 - DNA, 18 bp, Artificial Sequence
  synthetic
cagagcattagcagctat

SEQ ID NO: 476 - protein, 6 aa, Artificial Sequence
  synthetic
QSISSY

SEQ ID NO: 477 - DNA, 9 bp, Artificial Sequence
  synthetic
gctgcatcc

SEQ ID NO: 478 - protein, 3 aa, Artificial Sequence
  synthetic
AAS

SEQ ID NO: 479 - DNA, 30 bp, Artificial Sequence; identical to SEQ ID NO: 15
  synthetic

SEQ ID NO: 480 - protein, 10 aa, Artificial Sequence
  synthetic
QQSYSTPPIT

SEQ ID NO: 481 - DNA, 372 bp, Artificial Sequence
  synthetic
gaagtgcagctggtggagtctgggggaggcttggtacagcctggcaggtccctgaaactctcctgtacagcctctggattcacctttgctgattataccatgcactgggtccgacaaggtccagggaagggcctggagtgggtctcagatattagttggaatagtggtagtaaaggctatgcggactctgtgaagggccgattcaccatctccagagacaacgccaagaactccctgtatctgcaaatgaacagtctgagaactgaggacacggccttgtattactgtgcaaaagatatgagtggctacgcccactactactactacgctttggacgtctggggccaagggaccacggtcaccgtctcctca

SEQ ID NO: 482 - protein, 124 aa, Artificial Sequence
  synthetic
EVQLVESGGGLVQPGRSLKLSCTASGFTFADYTMHWVRQGPGKGLEWVSDISWNSGSKGYADSVKGRFTISRDNAKNSLYLQMNSLRTEDTALYYCAKDMSGYAHYYYYALDVWGQGTTVTVSS

SEQ ID NO: 483 - DNA, 24 bp, Artificial Sequence
  synthetic
ggattcacctttgctgattatacc

SEQ ID NO: 484 - protein, 8 aa, Artificial Sequence
  synthetic
GFTFADYT

SEQ ID NO: 485 - DNA, 24 bp, Artificial Sequence
  synthetic
attagttggaatagtggtagtaaa

SEQ ID NO: 486 - protein, 8 aa, Artificial Sequence
  synthetic
ISWNSGSK

SEQ ID NO: 487 - DNA, 51 bp, Artificial Sequence
  synthetic
gcaaaagatatgagtggctacgcccactactactactacgctttggacgtc

SEQ ID NO: 488 - protein, 17 aa, Artificial Sequence
  synthetic
AKDMSGYAHYYYYALDV

SEQ ID NO: 489 - DNA, 324 bp, Artificial Sequence
  synthetic
gacatccagatgacccagtctccatcctccctgtctgcatctgtaggagacagagtcaccatcacttgccgggcaagtcagagcattagcaactatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaaccccccgatcaccttcggccaagggacacgactggagattaaa

SEQ ID NO: 490 - protein, 108 aa, Artificial Sequence
  synthetic
DIQMTQSPSSLSASVGDRVTITCRASQSISNYLNWYQQKPGKAPKLLIYAASSLQSGVPSRFSGSGSGTDFTLTISSLQPEDFATYYCQQSYSNPPITFGQGTRLEIK

SEQ ID NO: 491 - DNA, 18 bp, Artificial Sequence
  synthetic
cagagcattagcaactat

SEQ ID NO: 492 - protein, 6 aa, Artificial Sequence
  synthetic
QSISNY

SEQ ID NO: 493 - DNA, 9 bp, Artificial Sequence
  synthetic
gctgcatcc

SEQ ID NO: 494 - protein, 3 aa, Artificial Sequence
  synthetic
AAS

SEQ ID NO: 495 - DNA, 30 bp, Artificial Sequence
  synthetic
caacagagttacagtaaccccccgatcacc

SEQ ID NO: 496 - protein, 10 aa, Artificial Sequence
  synthetic
QQSYSNPPIT

SEQ ID NO: 497 - DNA, 363 bp, Artificial Sequence
  synthetic
caggtgcagctggtggagtctgggggaggcgtggtccagcctgggaggtccctgagactctcctgtgcagcctctggattcaccttcagtagaaaaggcatgcactgggtccgccaggctccagtcaaggggctggagtgggtggcagttatatcatatgatggaagtaataaatactatgcagactccgtgaagggccgattcaccatctccagagacaattccaagaacacgctgtatctgcaaatgaacagcctgacagctgaggacacggctgtgtattactgtgcgaaagaaggggggcatgactatggtggtacctttgactactggggccagggaaccctggtcaccgtctcctca

SEQ ID NO: 498 - protein, 121 aa, Artificial Sequence
  synthetic
QVQLVESGGGVVQPGRSLRLSCAASGFTFSRKGMHWVRQAPVKGLEWVAVISYDGSNKYYADSVKGRFTISRDNSKNTLYLQMNSLTAEDTAVYYCAKEGGHDYGGTFDYWGQGTLVTVSS

SEQ ID NO: 499 - DNA, 24 bp, Artificial Sequence
  synthetic
ggattcaccttcagtagaaaaggc

SEQ ID NO: 500 - protein, 8 aa, Artificial Sequence
  synthetic
GFTFSRKG

SEQ ID NO: 501 - DNA, 24 bp, Artificial Sequence
  synthetic
atatcatatgatggaagtaataaa

SEQ ID NO: 502 - protein, 8 aa, Artificial Sequence
  synthetic
ISYDGSNK

SEQ ID NO: 503 - DNA, 42 bp, Artificial Sequence
  synthetic
gcgaaagaaggggggcatgactatggtggtacctttgactac

SEQ ID NO: 504 - protein, 14 aa, Artificial Sequence
  synthetic
AKEGGHDYGGTFDY

SEQ ID NO: 505 - DNA, 321 bp, Artificial Sequence
  synthetic
gacatccagatgacccagtctccatcctccctgtctgcatctgtaggagacagagtcaccatcacttgccaggcgagtcaggacattaacaactatttaaattggtatcagcagaaaccagggaaagcccctaagttcctgatctacgatgcatccaatttggaaacaggggtcccatcaaggttcagtggaagtggatctgggacagattttactttcaccatcagcagcctgcagcctgaagatattgcaacatattactgtcaacagtatgatgatctcccattcactttcggccctgggaccaaagtggatatcaaa

SEQ ID NO: 506 - protein, 107 aa, Artificial Sequence
  synthetic
DIQMTQSPSSLSASVGDRVTITCQASQDINNYLNWYQQKPGKAPKFLIYDASNLETGVPSRFSGSGSGTDFTFTISSLQPEDIATYYCQQYDDLPFTFGPGTKVDIK

SEQ ID NO: 507 - DNA, 18 bp, Artificial Sequence
  synthetic
caggacattaacaactat

SEQ ID NO: 508 - protein, 6 aa, Artificial Sequence
  synthetic
QDINNY

SEQ ID NO: 509 - DNA, 9 bp, Artificial Sequence
  synthetic
gatgcatcc

SEQ ID NO: 510 - protein, 3 aa, Artificial Sequence
  synthetic
DAS

SEQ ID NO: 511 - DNA, 27 bp, Artificial Sequence
  synthetic
caacagtatgatgatctcccattcact

SEQ ID NO: 512 - protein, 9 aa, Artificial Sequence
  synthetic
QQYDDLPFT

SEQ ID NO: 513 - DNA, 369 bp, Artificial Sequence
  synthetic
gaagtgcagctggtggagtctgggggaggcttggtacagcctggcaggtccctgagactctcctgtgcagcctctggattcacctttgatgattataccatgcactgggtccggcaagctccagggaagggcctggagtgggtctcaggtattagttggaatagtggtagtataggctatgcggactctgtgaagggccgattcaccatctccagagacaacgccaagaagtccctgtatctgcaaatgaacagtctgagagctgaggacacggccttgtattactgtgcaaaagataatagtggctacggtcactactactacggaatggacgtctggggccaagggaccacggtcaccgtcgcctca

SEQ ID NO: 514 - protein, 123 aa, Artificial Sequence
  synthetic
EVQLVESGGGLVQPGRSLRLSCAASGFTFDDYTMHWVRQAPGKGLEWVSGISWNSGSIGYADSVKGRFTISRDNAKKSLYLQMNSLRAEDTALYYCAKDNSGYGHYYYGMDVWGQGTTVTVAS

SEQ ID NO: 515 - DNA, 24 bp, Artificial Sequence
  synthetic
ggattcacctttgatgattatacc

SEQ ID NO: 516 - protein, 8 aa, Artificial Sequence
  synthetic
GFTFDDYT

SEQ ID NO: 517 - DNA, 24 bp, Artificial Sequence
  synthetic
attagttggaatagtggtagtata

SEQ ID NO: 518 - protein, 8 aa, Artificial Sequence
  synthetic
ISWNSGSI

SEQ ID NO: 519 - DNA, 48 bp, Artificial Sequence
  synthetic
gcaaaagataatagtggctacggtcactactactacggaatggacgtc

SEQ ID NO: 520 - protein, 16 aa, Artificial Sequence
  synthetic
AKDNSGYGHYYYGMDV

SEQ ID NO: 521 - DNA, 321 bp, Artificial Sequence
  synthetic
gaaatagtgatgacgcagtctccagccaccctgtctgtgtctccaggggaaagagccaccctctcctgcagggccagtcagagtgttagcagcaacttagcctggtaccagcaaaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcactatattaactggcctctcactttcggcggagggaccaaggtggagatcaaa

SEQ ID NO: 522 - protein, 107 aa, Artificial Sequence
  synthetic
EIVMTQSPATLSVSPGERATLSCRASQSVSSNLAWYQQKPGQAPRLLIYGASTRATGIPARFSGSGSGTEFTLTISSLQSEDFAVYYCQHYINWPLTFGGGTKVEIK

SEQ ID NO: 523 - DNA, 18 bp, Artificial Sequence
  synthetic
cagagtgttagcagcaac

SEQ ID NO: 524 - protein, 6 aa, Artificial Sequence
  synthetic
QSVSSN

SEQ ID NO: 525 - DNA, 9 bp, Artificial Sequence
  synthetic
ggtgcatcc

SEQ ID NO: 526 - protein, 3 aa, Artificial Sequence
  synthetic
GAS

SEQ ID NO: 527 - DNA, 27 bp, Artificial Sequence
  synthetic
cagcactatattaactggcctctcact

SEQ ID NO: 528 - protein, 9 aa, Artificial Sequence
  synthetic
QHYINWPLT

SEQ ID NO: 529 - DNA, 369 bp, Artificial Sequence; identical to SEQ ID NO: 513
  synthetic

SEQ ID NO: 530 - protein, 123 aa, Artificial Sequence; identical to SEQ ID NO: 514
  synthetic

SEQ ID NO: 531 - DNA, 24 bp, Artificial Sequence
  synthetic
ggattcacctttgatgattatacc

SEQ ID NO: 532 - protein, 8 aa, Artificial Sequence
  synthetic
GFTFDDYT

SEQ ID NO: 533 - DNA, 24 bp, Artificial Sequence
  synthetic
attagttggaatagtggtagtata

SEQ ID NO: 534 - protein, 8 aa, Artificial Sequence
  synthetic
ISWNSGSI

SEQ ID NO: 535 - DNA, 48 bp, Artificial Sequence; identical to SEQ ID NO: 519
  synthetic

SEQ ID NO: 536 - protein, 16 aa, Artificial Sequence
  synthetic
AKDNSGYGHYYYGMDV

SEQ ID NO: 537 - DNA, 321 bp, Artificial Sequence; identical to SEQ ID NO: 521
  synthetic

SEQ ID NO: 538 - protein, 107 aa, Artificial Sequence; identical to SEQ ID NO: 522
  synthetic

SEQ ID NO: 539 - DNA, 18 bp, Artificial Sequence
  synthetic
cagagtgttagcagcaac

SEQ ID NO: 540 - protein, 6 aa, Artificial Sequence
  synthetic
QSVSSN

SEQ ID NO: 541 - DNA, 9 bp, Artificial Sequence
  synthetic
ggtgcatcc

SEQ ID NO: 542 - protein, 3 aa, Artificial Sequence
  synthetic
GAS

SEQ ID NO: 543 - DNA, 27 bp, Artificial Sequence
  synthetic
cagcactatattaactggcctctcact

SEQ ID NO: 544 - protein, 9 aa, Artificial Sequence
  synthetic
QHYINWPLT

SEQ ID NO: 545 - DNA, 354 bp, Artificial Sequence
  synthetic
caggtgcagttggtggagtctgggggaggcgtggtccagcctgggaggtccctgagactctcctgtggtgcgtctggattcaccttcagaagttatggcatgcactgggtccgccagactccaggcagggggctggagtgggtggcaatgatatattatgatggaaataataaatactatgcagactccgtgaggggccgattcaccgtttccagagacaattccaagaacaccctgtatctgcaaatgagcagcctgagagccgaggacacggctctatatttctgtgcgcgagggcctgggtacaactggctcgacccctggggccagggaaccctggtcaccgtctcctca

SEQ ID NO: 546 - protein, 118 aa, Artificial Sequence
  synthetic
QVQLVESGGGVVQPGRSLRLSCGASGFTFRSYGMHWVRQTPGRGLEWVAMIYYDGNNKYYADSVRGRFTVSRDNSKNTLYLQMSSLRAEDTALYFCARGPGYNWLDPWGQGTLVTVSS

SEQ ID NO: 547 - DNA, 24 bp, Artificial Sequence
  synthetic
ggattcaccttcagaagttatggc

SEQ ID NO: 548 - protein, 8 aa, Artificial Sequence
  synthetic
GFTFRSYG

SEQ ID NO: 549 - DNA, 24 bp, Artificial Sequence
  synthetic
atatattatgatggaaataataaa

SEQ ID NO: 550 - protein, 8 aa, Artificial Sequence
  synthetic
IYYDGNNK

SEQ ID NO: 551 - DNA, 33 bp, Artificial Sequence
  synthetic
gcgcgagggcctgggtacaactggctcgacccc

SEQ ID NO: 552 - protein, 11 aa, Artificial Sequence
  synthetic
ARGPGYNWLDP

SEQ ID NO: 553 - DNA, 321 bp, Artificial Sequence
  synthetic
gaaatagtgatgacgcagtctccagccaccctgtctgtgtctccaggggaaagagccaccctctcctgcagggccagtcagagtattagcaggaacttggcctggtaccagcaraaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataaccggcctctcactttcggcggagggaccgaggtggagatcaaa

SEQ ID NO: 554 - protein, 107 aa, Artificial Sequence
  synthetic
  VARIANT (38)..(38): Xaa = Any Amino Acid
EIVMTQSPATLSVSPGERATLSCRASQSISRNLAWYQXKPGQAPRLLIYGASTRATGIPARFSGSGSGTEFTLTISSLQSEDFAVYYCQQYNNRPLTFGGGTEVEIK

SEQ ID NO: 555 - DNA, 18 bp, Artificial Sequence
  synthetic
cagagtattagcaggaac

SEQ ID NO: 556 - protein, 6 aa, Artificial Sequence
  synthetic
QSISRN

SEQ ID NO: 557 - DNA, 9 bp, Artificial Sequence
  synthetic
ggtgcatcc

SEQ ID NO: 558 - protein, 3 aa, Artificial Sequence
  synthetic
GAS

SEQ ID NO: 559 - DNA, 27 bp, Artificial Sequence
  synthetic
cagcagtataataaccggcctctcact

SEQ ID NO: 560 - protein, 9 aa, Artificial Sequence
  synthetic
QQYNNRPLT

SEQ ID NO: 561 - DNA, 354 bp, Artificial Sequence
  synthetic
caggtgcagttggtggagtctgggggaggcgtggtccagcctgggaggtccctgagactcgcctgtgttgcgtctggattcaccttcagaagttatggcatgcactgggtccgccaggctccaggcaagggactgcagtgggtggcaatgatttactatgatggtaagaataaatattatgcagactccgtgaggggccgattcaccatctccagagacaattccaagaacacactgtatctgcaaatgaacaatctgagagtcgaggacacggctatgtatttctgtgcgcgagggcctgggtacaattggctcgacccctggggccagggaaccctggtcactgtttcctca

SEQ ID NO: 562 - protein, 118 aa, Artificial Sequence
  synthetic
QVQLVESGGGVVQPGRSLRLACVASGFTFRSYGMHWVRQAPGKGLQWVAMIYYDGKNKYYADSVRGRFTISRDNSKNTLYLQMNNLRVEDTAMYFCARGPGYNWLDPWGQGTLVTVSS

SEQ ID NO: 563 - DNA, 24 bp, Artificial Sequence
  synthetic
ggattcaccttcagaagttatggc

SEQ ID NO: 564 - protein, 8 aa, Artificial Sequence
  synthetic
GFTFRSYG

SEQ ID NO: 565 - DNA, 24 bp, Artificial Sequence
  synthetic
atttactatgatggtaagaataaa

SEQ ID NO: 566 - protein, 8 aa, Artificial Sequence
  synthetic
IYYDGKNK

SEQ ID NO: 567 - DNA, 33 bp, Artificial Sequence
  synthetic
gcgcgagggcctgggtacaattggctcgacccc

SEQ ID NO: 568 - protein, 11 aa, Artificial Sequence
  synthetic
ARGPGYNWLDP

SEQ ID NO: 569 - DNA, 321 bp, Artificial Sequence
  synthetic
gaaatagtgatgacgcagtctccagccaccctgtctgtgtctccaggggaaagagccaccctctcctgcagggccagtcagagaattagcagcaacttggcctggtaccagcaaaaacctggccaggctcccaggctcctcatctatggtgcatccaccagggccactggtagcccagccaggttcagtggcagtgggtctgggacagacttcactctcaccatcagcagcctgcagtctgaggatgttgcagtttattactgtcagcaacatcataactggcctctcactttcggcggagggaccaaggtggagatcaaa

SEQ ID NO: 570 - protein, 107 aa, Artificial Sequence
  synthetic
EIVMTQSPATLSVSPGERATLSCRASQRISSNLAWYQQKPGQAPRLLIYGASTRATGSPARFSGSGSGTDFTLTISSLQSEDVAVYYCQQHHNWPLTFGGGTKVEIK

SEQ ID NO: 571 - DNA, 18 bp, Artificial Sequence
  synthetic
cagagaattagcagcaac

SEQ ID NO: 572 - protein, 6 aa, Artificial Sequence
  synthetic
QRISSN

SEQ ID NO: 573 - DNA, 9 bp, Artificial Sequence
  synthetic
ggtgcatcc

SEQ ID NO: 574 - protein, 3 aa, Artificial Sequence
  synthetic
GAS

SEQ ID NO: 575 - DNA, 27 bp, Artificial Sequence
  synthetic
cagcaacatcataactggcctctcact

SEQ ID NO: 576 - protein, 9 aa, Artificial Sequence
  synthetic
QQHHNWPLT

SEQ ID NO: 577 - DNA, 354 bp, Artificial Sequence
  synthetic
caggtgcagctggtggagtctgggggaggcgtggtccagcctgggaggtccctgagactctcctgtgctgcgtctggatttaccttcagaagttatgccatgcactgggtccgccaggctccaggcaaggggctggagtgggtggcaatggtatactatgatggaaataatcaatactatgcagactccgtgaggggccgattcaccatctccagagacaattccaagaacacgctgtatctgcaaatgaacagcctgagagccgatgacacggctgtgtatttctgtgcgcgagggcctgggtacaactggctcgacccctggggccagggaaccctggtcaccgtctcctca

SEQ ID NO: 578 - protein, 118 aa, Artificial Sequence
  synthetic
QVQLVESGGGVVQPGRSLRLSCAASGFTFRSYAMHWVRQAPGKGLEWVAMVYYDGNNQYYADSVRGRFTISRDNSKNTLYLQMNSLRADDTAVYFCARGPGYNWLDPWGQGTLVTVSS

SEQ ID NO: 579 - DNA, 24 bp, Artificial Sequence
  synthetic
ggatttaccttcagaagttatgcc

SEQ ID NO: 580 - protein, 8 aa, Artificial Sequence
  synthetic
GFTFRSYA

SEQ ID NO: 581 - DNA, 24 bp, Artificial Sequence
  synthetic
gtatactatgatggaaataatcaa

SEQ ID NO: 582 - protein, 8 aa, Artificial Sequence
  synthetic
VYYDGNNQ

SEQ ID NO: 583 - DNA, 33 bp, Artificial Sequence; identical to SEQ ID NO: 551
  synthetic

SEQ ID NO: 584 - protein, 11 aa, Artificial Sequence
  synthetic
ARGPGYNWLDP

SEQ ID NO: 585 - DNA, 321 bp, Artificial Sequence
  synthetic
gaaatagtgatgacgcagtctccagccaccctgtctgtgtctccaggggaaagagccaccctctcctgcagggccagtcagagtgttagcaggaacttggcctggtaccagcaaaaacctggccaggctcccaggctcctcatctatggtgcatccaccagggccactggtatcccggccaggttcagtggcagtgggtctgggacagacttcactctcaccatcagcagcctgcagtctgaagattttgcagtttattactgtcagcagtataataactggcctctcactttcggcggagggaccaaggtggtgatcaaa

SEQ ID NO: 586 - protein, 107 aa, Artificial Sequence
  synthetic
EIVMTQSPATLSVSPGERATLSCRASQSVSRNLAWYQQKPGQAPRLLIYGASTRATGIPARFSGSGSGTDFTLTISSLQSEDFAVYYCQQYNNWPLTFGGGTKVVIK

SEQ ID NO: 587 - DNA, 18 bp, Artificial Sequence
  synthetic
cagagtgttagcaggaac

SEQ ID NO: 588 - protein, 6 aa, Artificial Sequence
  synthetic
QSVSRN

SEQ ID NO: 589 - DNA, 9 bp, Artificial Sequence
  synthetic
ggtgcatcc

SEQ ID NO: 590 - protein, 3 aa, Artificial Sequence
  synthetic
GAS

SEQ ID NO: 591 - DNA, 27 bp, Artificial Sequence
  synthetic
cagcagtataataactggcctctcact

SEQ ID NO: 592 - protein, 9 aa, Artificial Sequence
  synthetic
QQYNNWPLT

SEQ ID NO: 593 - DNA, 354 bp, Artificial Sequence
  synthetic
caggtgcagctggtggagtctgggggaggcgtggtccagcctgggaggtccctgagactctcctgtattgcgtctggatttaccttcagaagttatggcatgcactgggtccgccaggctccaggcaaggggctggagtgggtggcaatgatatattatgatggaaacaataaatactatgcagactccgtgaggggccgattcaccatctccagagacaactccaagaacacgctgtatctgcaaatgaacagcctgagagccgatgacacggctgtgtatttctgtgcgcgagggcctgggtacaactggctcgacccctggggccagggaaccctggtcaccgtctcctca

SEQ ID NO: 594 - protein, 118 aa, Artificial Sequence
  synthetic
QVQLVESGGGVVQPGRSLRLSCIASGFTFRSYGMHWVRQAPGKGLEWVAMIYYDGNNKYYADSVRGRFTISRDNSKNTLYLQMNSLRADDTAVYFCARGPGYNWLDPWGQGTLVTVSS

SEQ ID NO: 595 - DNA, 24 bp, Artificial Sequence
  synthetic
ggatttaccttcagaagttatggc

SEQ ID NO: 596 - protein, 8 aa, Artificial Sequence
  synthetic
GFTFRSYG

SEQ ID NO: 597 - DNA, 24 bp, Artificial Sequence
  synthetic
atatattatgatggaaacaataaa

SEQ ID NO: 598 - protein, 8 aa, Artificial Sequence
  synthetic
IYYDGNNK

SEQ ID NO: 599 - DNA, 33 bp, Artificial Sequence; identical to SEQ ID NO: 551
  synthetic

SEQ ID NO: 600 - protein, 11 aa, Artificial Sequence
  synthetic
ARGPGYNWLDP

SEQ ID NO: 601 - DNA, 321 bp, Artificial Sequence
  synthetic
gaaatagtgatgacgcagtctccagccacactgtctgtgtctccaggggaaagagccaccctctcctgcagggccagtcagagtgttagcagcaacttggcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataacaggcctctcactttcggcggagggaccaaggtggagatcaaa

SEQ ID NO: 602 - protein, 107 aa, Artificial Sequence
  synthetic
EIVMTQSPATLSVSPGERATLSCRASQSVSSNLAWYQQKPGQAPRLLIYGASTRATGIPARFSGSGSGTEFTLTISSLQSEDFAVYYCQQYNNRPLTFGGGTKVEIK

SEQ ID NO: 603 - DNA, 18 bp, Artificial Sequence
  synthetic
cagagtgttagcagcaac

SEQ ID NO: 604 - protein, 6 aa, Artificial Sequence
  synthetic
QSVSSN

SEQ ID NO: 605 - DNA, 9 bp, Artificial Sequence
  synthetic
ggtgcatcc

SEQ ID NO: 606 - protein, 3 aa, Artificial Sequence
  synthetic
GAS

SEQ ID NO: 607 - DNA, 27 bp, Artificial Sequence
  synthetic
cagcagtataataacaggcctctcact

SEQ ID NO: 608 - protein, 9 aa, Artificial Sequence
  synthetic
QQYNNRPLT

SEQ ID NO: 609 - DNA, 354 bp, Artificial Sequence
  synthetic
caggtgcagctggtggagtctgggggaggcgtggtccagccggggaggtccctgagactctcctgtgctgcgtctggattcaccttcagaagttttggcatgcactgggtccgccaggctccaggcaggggactggagtgggtggcaatgatatattttgatggaaaaaataaatactatgcagactccgtgaggggccgattcaccatttccagagacaattccaagaacaccctgtatctggaaatgagtagcctgagagccgaggacacggctgtatatttctgtgcgcgagggcctgggtacaactggctcgacccctggggccagggaaccctggtcaccgtctcctca

SEQ ID NO: 610 - protein, 118 aa, Artificial Sequence
  synthetic
QVQLVESGGGVVQPGRSLRLSCAASGFTFRSFGMHWVRQAPGRGLEWVAMIYFDGKNKYYADSVRGRFTISRDNSKNTLYLEMSSLRAEDTAVYFCARGPGYNWLDPWGQGTLVTVSS

SEQ ID NO: 611 - DNA, 24 bp, Artificial Sequence
  synthetic
ggattcaccttcagaagttttggc

SEQ ID NO: 612 - protein, 8 aa, Artificial Sequence
  synthetic
GFTFRSFG

SEQ ID NO: 613 - DNA, 24 bp, Artificial Sequence
  synthetic
atatattttgatggaaaaaataaa

SEQ ID NO: 614 - protein, 8 aa, Artificial Sequence
  synthetic
IYFDGKNK

SEQ ID NO: 615 - DNA, 33 bp, Artificial Sequence; identical to SEQ ID NO: 551
  synthetic

SEQ ID NO: 616 - protein, 11 aa, Artificial Sequence
  synthetic
ARGPGYNWLDP

SEQ ID NO: 617 - DNA, 321 bp, Artificial Sequence
  synthetic
gaaatagtgatgacgcagtctccagccaccctgtctgtgtctccaggggaaagagtcaccctctcctgtagggccagtcagagtattagcaggaacttggcctggtaccagcagaaacctggccaggctcccaggctcctcatctatggtgcatccaccagggccactggtgtcccagccaggttcagtggcagtgggtctgggacagagttcactctcaccatcagcagcctacagtctgaagattttgcagtttttcactgtcagcagtataataataggcctctcactttcggcggagggaccgaggtggagatcaaa

SEQ ID NO: 618 - protein, 107 aa, Artificial Sequence
  synthetic
EIVMTQSPATLSVSPGERVTLSCRASQSISRNLAWYQQKPGQAPRLLIYGASTRATGVPARFSGSGSGTEFTLTISSLQSEDFAVFHCQQYNNRPLTFGGGTEVEIK

SEQ ID NO: 619 - DNA, 18 bp, Artificial Sequence
  synthetic
cagagtattagcaggaac

SEQ ID NO: 620 - protein, 6 aa, Artificial Sequence
  synthetic
QSISRN

SEQ ID NO: 621 - DNA, 9 bp, Artificial Sequence
  synthetic
ggtgcatcc

SEQ ID NO: 622 - protein, 3 aa, Artificial Sequence
  synthetic
GAS

SEQ ID NO: 623 - DNA, 27 bp, Artificial Sequence
  synthetic
cagcagtataataataggcctctcact

SEQ ID NO: 624 - protein, 9 aa, Artificial Sequence
  synthetic
QQYNNRPLT

SEQ ID NO: 625 - DNA, 354 bp, Artificial Sequence
  synthetic
caggtgcaattggtggagtctgggggaggcgtggtccagccggggaggtccctgagactctcctgtgctgcgtctggattcaccttcagaagttttggcatgcactgggtccgccaggctccaggcaggggactggagtgggtggcaatgatatattttgatggaaaaaataaatactatgcagactccgtgaggggccgattcaccatttccagagacaattccaagaacaccctgtatctggaaatgagtagcctgagagccgaggacacggctgtatatttctgtgcgcgagggcctgggtacaactggctcgacccctggggccagggaaccctggtcaccgtctcctca

SEQ ID NO: 626 - protein, 118 aa, Artificial Sequence; identical to SEQ ID NO: 610
  synthetic

SEQ ID NO: 627 - DNA, 24 bp, Artificial Sequence
  synthetic
ggattcaccttcagaagttttggc

SEQ ID NO: 628 - protein, 8 aa, Artificial Sequence
  synthetic
GFTFRSFG

SEQ ID NO: 629 - DNA, 24 bp, Artificial Sequence
  synthetic
atatattttgatggaaaaaataaa

SEQ ID NO: 630 - protein, 8 aa, Artificial Sequence
  synthetic
IYFDGKNK

SEQ ID NO: 631 - DNA, 33 bp, Artificial Sequence; identical to SEQ ID NO: 551
  synthetic

SEQ ID NO: 632 - protein, 11 aa, Artificial Sequence
  synthetic
ARGPGYNWLDP

SEQ ID NO: 633 - DNA, 321 bp, Artificial Sequence
  synthetic
gaaatagtgatgacgcagtctccagccaccctgtctgtgtctccaggggaaagagtcaccctctcctgtagggccagtcagagtattagcaggaacttggcctggtaccagcaraaacctggccaggctcccaggctcctcatctatggtgcatccaccagggccactggtgtcccagccaggttcagtggcagtgggtctgggacagagttcactctcaccatcagcagcctacagtctgaagattttgcagtttttcactgtcagcagtataataataggcctctcactttcggcggagggaccgaggtggagatcaaa

SEQ ID NO: 634 - protein, 107 aa, Artificial Sequence
  synthetic
  VARIANT (38)..(38): Xaa = Any Amino Acid
EIVMTQSPATLSVSPGERVTLSCRASQSISRNLAWYQXKPGQAPRLLIYGASTRATGVPARFSGSGSGTEFTLTISSLQSEDFAVFHCQQYNNRPLTFGGGTEVEIK

SEQ ID NO: 635 - DNA, 18 bp, Artificial Sequence
  synthetic
cagagtattagcaggaac

SEQ ID NO: 636 - protein, 6 aa, Artificial Sequence
  synthetic
QSISRN

SEQ ID NO: 637 - DNA, 9 bp, Artificial Sequence
  synthetic
ggtgcatcc

SEQ ID NO: 638 - protein, 3 aa, Artificial Sequence
  synthetic
GAS

SEQ ID NO: 639 - DNA, 27 bp, Artificial Sequence
  synthetic
cagcagtataataataggcctctcact

SEQ ID NO: 640 - protein, 9 aa, Artificial Sequence
  synthetic
QQYNNRPLT

SEQ ID NO: 641 - DNA, 354 bp, Artificial Sequence
  synthetic
caggtgcaattggtggagtctgggggaggcgtggtccagccggggaggtccctgagactctcctgtgctgcgtctggattcaccttcagaagttttggcatgcactgggtccgccaggctccaggcaggggactggagtgggtggcaatgatatattttgatggaaaaaataaatactatgcagactccgtgaggggccgattcaccatttccagagacaattccaagaacaccctgtatctggaaatgagcagcctgagagccgaggacacggctgtatatttctgtgcgcgagggcctgggtacaattggctcgacccctggggccagggaaccctggtcaccgtctcctca

SEQ ID NO: 642 - protein, 118 aa, Artificial Sequence; identical to SEQ ID NO: 610
  synthetic

SEQ ID NO: 643 - DNA, 24 bp, Artificial Sequence
  synthetic
ggattcaccttcagaagttttggc

SEQ ID NO: 644 - protein, 8 aa, Artificial Sequence
  synthetic
GFTFRSFG

SEQ ID NO: 645 - DNA, 24 bp, Artificial Sequence
  synthetic
atatattttgatggaaaaaataaa

SEQ ID NO: 646 - protein, 8 aa, Artificial Sequence
  synthetic
IYFDGKNK

SEQ ID NO: 647 - DNA, 33 bp, Artificial Sequence; identical to SEQ ID NO: 567
  synthetic

SEQ ID NO: 648 - protein, 11 aa, Artificial Sequence
  synthetic
ARGPGYNWLDP

SEQ ID NO: 649 - DNA, 321 bp, Artificial Sequence
  synthetic
gaaatagtgatgacgcagtctccagccaccctgtctgtgtctccaggggaaagagccaccctctcctgtagggccagtcagagtgttagcaggaacttggcctggtaccagcaaaaacctggccaggctcccaggctcctcatctatggtgcatccaccagggccactggtgtcccagccaggttcagtggcagtgggtctgggacagagttcactctcaccatcagcagcctacagtctgaagattttgcagtttttcactgtcagcagtataataataggcctctcactttcggcggagggaccgaggtggagatcaaa

SEQ ID NO: 650 - protein, 107 aa, Artificial Sequence
  synthetic
EIVMTQSPATLSVSPGERATLSCRASQSVSRNLAWYQQKPGQAPRLLIYGASTRATGVPARFSGSGSGTEFTLTISSLQSEDFAVFHCQQYNNRPLTFGGGTEVEIK

SEQ ID NO: 651 - DNA, 18 bp, Artificial Sequence
  synthetic
cagagtgttagcaggaac

SEQ ID NO: 652 - protein, 6 aa, Artificial Sequence
  synthetic
QSVSRN

SEQ ID NO: 653 - DNA, 9 bp, Artificial Sequence
  synthetic
ggtgcatcc

SEQ ID NO: 654 - protein, 3 aa, Artificial Sequence
  synthetic
GAS

SEQ ID NO: 655 - DNA, 27 bp, Artificial Sequence
  synthetic
cagcagtataataataggcctctcact

SEQ ID NO: 656 - protein, 9 aa, Artificial Sequence
  synthetic
QQYNNRPLT

SEQ ID NO: 657 - DNA, 354 bp, Artificial Sequence; identical to SEQ ID NO: 641
  synthetic

SEQ ID NO: 658 - protein, 118 aa, Artificial Sequence; identical to SEQ ID NO: 610
  synthetic

SEQ ID NO: 659 - DNA, 24 bp, Artificial Sequence
  synthetic
ggattcaccttcagaagttttggc

SEQ ID NO: 660 - protein, 8 aa, Artificial Sequence
  synthetic
GFTFRSFG

SEQ ID NO: 661 - DNA, 24 bp, Artificial Sequence
  synthetic
atatattttgatggaaaaaataaa

SEQ ID NO: 662 - protein, 8 aa, Artificial Sequence
  synthetic
IYFDGKNK

SEQ ID NO: 663 - DNA, 33 bp, Artificial Sequence; identical to SEQ ID NO: 567
  synthetic

SEQ ID NO: 664 - protein, 11 aa, Artificial Sequence
  synthetic
ARGPGYNWLDP

SEQ ID NO: 665 - DNA, 321 bp, Artificial Sequence; identical to SEQ ID NO: 649
  synthetic

SEQ ID NO: 666 - protein, 107 aa, Artificial Sequence; identical to SEQ ID NO: 650
  synthetic

SEQ ID NO: 667 - DNA, 18 bp, Artificial Sequence
  synthetic
cagagtgttagcaggaac

SEQ ID NO: 668 - protein, 6 aa, Artificial Sequence
  synthetic
QSVSRN

SEQ ID NO: 669 - DNA, 9 bp, Artificial Sequence
  synthetic
ggtgcatcc

SEQ ID NO: 670 - protein, 3 aa, Artificial Sequence
  synthetic
GAS

SEQ ID NO: 671 - DNA, 27 bp, Artificial Sequence
  synthetic
cagcagtataataataggcctctcact

SEQ ID NO: 672 - protein, 9 aa, Artificial Sequence
  synthetic
QQYNNRPLT

SEQ ID NO: 673 - DNA, 354 bp, Artificial Sequence
  synthetic
caggtgcagttggtggagtctgggggaggcgtggtccagcctgggaggtccctgagactctcctgtgttgcgtctggattcaccttcagaagttatggcatgcactgggtccgccaggctccaggcaagggactgcagtgggtggcaatgatttactatgatggtaagaataaatattatgcagactccgtgaggggccgattcaccatctccagagacaattccaagaacacgctgtatctgcaaatgaacagtctgagagccgaagacacggctatgtatttctgtgcgcgagggcctgggtacaactggctcgacccctggggccagggaaccctggtcactgtctcctca

SEQ ID NO: 674 - protein, 118 aa, Artificial Sequence
  synthetic
QVQLVESGGGVVQPGRSLRLSCVASGFTFRSYGMHWVRQAPGKGLQWVAMIYYDGKNKYYADSVRGRFTISRDNSKNTLYLQMNSLRAEDTAMYFCARGPGYNWLDPWGQGTLVTVSS

SEQ ID NO: 675 - DNA, 24 bp, Artificial Sequence
  synthetic
ggattcaccttcagaagttatggc

SEQ ID NO: 676 - protein, 8 aa, Artificial Sequence
  synthetic
GFTFRSYG

SEQ ID NO: 677 - DNA, 24 bp, Artificial Sequence
  synthetic
atttactatgatggtaagaataaa

SEQ ID NO: 678 - protein, 8 aa, Artificial Sequence
  synthetic
IYYDGKNK

SEQ ID NO: 679 - DNA, 33 bp, Artificial Sequence; identical to SEQ ID NO: 551
  synthetic

SEQ ID NO: 680 - protein, 11 aa, Artificial Sequence
  synthetic
ARGPGYNWLDP

SEQ ID NO: 681 - DNA, 321 bp, Artificial Sequence
  synthetic
gaaatagtgatgacgcagtctccagccaccctgtctgtgtctccaggggaaagagccaccctctcctgcagggccagtcagagaattagcagcaacttggcctggtaccagcaaaaacctggccaggctcccaggctcctcatctatggtgcatccaccagggccactggtagcccagccaggttcagtggcagtgggtctgggacagagttcactctcaccatcagcagcctgcagtctgaagatgttgcagtttattactgtcagcaacataataactggcctctcactttcggcggagggaccaaggtggagatcaaa

SEQ ID NO: 682 - protein, 107 aa, Artificial Sequence
  synthetic
EIVMTQSPATLSVSPGERATLSCRASQRISSNLAWYQQKPGQAPRLLIYGASTRATGSPARFSGSGSGTEFTLTISSLQSEDVAVYYCQQHNNWPLTFGGGTKVEIK

SEQ ID NO: 683 - DNA, 18 bp, Artificial Sequence
  synthetic
cagagaattagcagcaac

SEQ ID NO: 684 - protein, 6 aa, Artificial Sequence
  synthetic
QRISSN

SEQ ID NO: 685 - DNA, 9 bp, Artificial Sequence
  synthetic
ggtgcatcc

SEQ ID NO: 686 - protein, 3 aa, Artificial Sequence
  synthetic
GAS

SEQ ID NO: 687 - DNA, 27 bp, Artificial Sequence
  synthetic
cagcaacataataactggcctctcact

SEQ ID NO: 688 - protein, 9 aa, Artificial Sequence
  synthetic
QQHNNWPLT

SEQ ID NO: 689 - DNA, 354 bp, Artificial Sequence
  synthetic
caggtgcaattggtggagtctgggggaggcgtggtccagccggggaggtccctgagactctcctgtgctgcgtctggtttcaccttcagaagttttggcatgcactgggtccgccaggctccaggcaggggactggagtgggtggcaatgatatattttgatggaaaaaataaatactatgcagactccgtgaggggccgattcaccatttccagagacaattccaagaacaccctgtatctggaaatgagtagcctgagagccgaggacacggctgtatatttctgtgcgcgagggcctgggtacaactggctcgacccctggggccagggaaccctggtcaccgtctcctca

SEQ ID NO: 690 - protein, 118 aa, Artificial Sequence; identical to SEQ ID NO: 610
  synthetic

SEQ ID NO: 691 - DNA, 24 bp, Artificial Sequence
  synthetic
ggtttcaccttcagaagttttggc

SEQ ID NO: 692 - protein, 8 aa, Artificial Sequence
  synthetic
GFTFRSFG

SEQ ID NO: 693 - DNA, 24 bp, Artificial Sequence
  synthetic
atatattttgatggaaaaaataaa

SEQ ID NO: 694 - protein, 8 aa, Artificial Sequence
  synthetic
IYFDGKNK

SEQ ID NO: 695 - DNA, 33 bp, Artificial Sequence; identical to SEQ ID NO: 551
  synthetic

SEQ ID NO: 696 - protein, 11 aa, Artificial Sequence
  synthetic
ARGPGYNWLDP

SEQ ID NO: 697 - DNA, 321 bp, Artificial Sequence
  synthetic
gaaatagtgatgacgcagtctccagccaccctgtctgtgtctccaggggaaagagtcatcctctcctgtagggccagtcagagtattagcaggaacttggcctggtaccagcaaaaacctggccaggctcccaggctcctcatctatggtgcaaccaccagggccactggtgtcccagccaggttcagtggcagtgggtctgggacagagttcactctcaccatcagcagcctacagtctgaagattttgcagttttttactgtcagcagtataataataggcctctcactttcggcggagggaccgaggtggagatcaaa

SEQ ID NO: 698 - protein, 107 aa, Artificial Sequence
  synthetic
EIVMTQSPATLSVSPGERVILSCRASQSISRNLAWYQQKPGQAPRLLIYGATTRATGVPARFSGSGSGTEFTLTISSLQSEDFAVFYCQQYNNRPLTFGGGTEVEIK

SEQ ID NO: 699 - DNA, 18 bp, Artificial Sequence
  synthetic
cagagtattagcaggaac

SEQ ID NO: 700 - protein, 6 aa, Artificial Sequence
  synthetic
QSISRN

SEQ ID NO: 701 - DNA, 9 bp, Artificial Sequence
  synthetic
ggtgcaacc

SEQ ID NO: 702 - protein, 3 aa, Artificial Sequence
  synthetic
GAT

SEQ ID NO: 703 - DNA, 27 bp, Artificial Sequence
  synthetic
cagcagtataataataggcctctcact

SEQ ID NO: 704 - protein, 9 aa, Artificial Sequence
  synthetic
QQYNNRPLT

SEQ ID NO: 705 - DNA, 354 bp, Artificial Sequence; identical to SEQ ID NO: 689
  synthetic

SEQ ID NO: 706 - protein, 118 aa, Artificial Sequence; identical to SEQ ID NO: 610
  synthetic

SEQ ID NO: 707 - DNA, 24 bp, Artificial Sequence
  synthetic
ggtttcaccttcagaagttttggc

SEQ ID NO: 708 - protein, 8 aa, Artificial Sequence
  synthetic
GFTFRSFG

SEQ ID NO: 709 - DNA, 24 bp, Artificial Sequence
  synthetic
atatattttgatggaaaaaataaa

SEQ ID NO: 710 - protein, 8 aa, Artificial Sequence
  synthetic
IYFDGKNK

SEQ ID NO: 711 - DNA, 33 bp, Artificial Sequence; identical to SEQ ID NO: 551
  synthetic

SEQ ID NO: 712 - protein, 11 aa, Artificial Sequence
  synthetic
ARGPGYNWLDP

SEQ ID NO: 713 - DNA, 321 bp, Artificial Sequence
  synthetic
gaaatagtgatgacgcagtctccagccaccctgtctgtgtctccaggggaaagagtcatcctctcctgtagggccagtcagagtattagcaggaacttggcctggtaccagcaraaacctggccaggctcccaggctcctcatctatggtgcaaccaccagggccactggtgtcccagccaggttcagtggcagtgggtctgggacagagttcactctcaccatcagcagcctacagtctgaagattttgcagttttttactgtcagcagtataataataggcctctcactttcggcggagggaccgaggtggagatcaaa

SEQ ID NO: 714 - protein, 107 aa, Artificial Sequence
  synthetic
  VARIANT (38)..(38): Xaa = Any Amino Acid
EIVMTQSPATLSVSPGERVILSCRASQSISRNLAWYQXKPGQAPRLLIYGATTRATGVPARFSGSGSGTEFTLTISSLQSEDFAVFYCQQYNNRPLTFGGGTEVEIK

SEQ ID NO: 715 - DNA, 18 bp, Artificial Sequence
  synthetic
cagagtattagcaggaac

SEQ ID NO: 716 - protein, 6 aa, Artificial Sequence
  synthetic
QSISRN

SEQ ID NO: 717 - DNA, 9 bp, Artificial Sequence
  synthetic
ggtgcaacc

SEQ ID NO: 718 - protein, 3 aa, Artificial Sequence
  synthetic
GAT

SEQ ID NO: 719 - DNA, 27 bp, Artificial Sequence
  synthetic
cagcagtataataataggcctctcact

SEQ ID NO: 720 - protein, 9 aa, Artificial Sequence
  synthetic
QQYNNRPLT

SEQ ID NO: 721 - DNA, 354 bp, Artificial Sequence; identical to SEQ ID NO: 593
  synthetic

SEQ ID NO: 722 - protein, 118 aa, Artificial Sequence; identical to SEQ ID NO: 594
  synthetic

SEQ ID NO: 723 - DNA, 24 bp, Artificial Sequence
  synthetic
ggatttaccttcagaagttatggc

SEQ ID NO: 724 - protein, 8 aa, Artificial Sequence
  synthetic
GFTFRSYG

SEQ ID NO: 725 - DNA, 24 bp, Artificial Sequence
  synthetic
atatattatgatggaaacaataaa

SEQ ID NO: 726 - protein, 8 aa, Artificial Sequence
  synthetic
IYYDGNNK

SEQ ID NO: 727 - DNA, 33 bp, Artificial Sequence; identical to SEQ ID NO: 551
  synthetic

SEQ ID NO: 728 - protein, 11 aa, Artificial Sequence
  synthetic
ARGPGYNWLDP

SEQ ID NO: 729 - DNA, 321 bp, Artificial Sequence; identical to SEQ ID NO: 601
  synthetic

SEQ ID NO: 730 - protein, 107 aa, Artificial Sequence; identical to SEQ ID NO: 602
  synthetic

SEQ ID NO: 731 - DNA, 18 bp, Artificial Sequence
  synthetic
cagagtgttagcagcaac

SEQ ID NO: 732 - protein, 6 aa, Artificial Sequence
  synthetic
QSVSSN

SEQ ID NO: 733 - DNA, 9 bp, Artificial Sequence
  synthetic
ggtgcatcc

SEQ ID NO: 734 - protein, 3 aa, Artificial Sequence
  synthetic
GAS

SEQ ID NO: 735 - DNA, 27 bp, Artificial Sequence
  synthetic
cagcagtataataacaggcctctcact

SEQ ID NO: 736 - protein, 9 aa, Artificial Sequence
  synthetic
QQYNNRPLT

SEQ ID NO: 737 - DNA, 372 bp, Artificial Sequence
  synthetic
gaagtgcagctggtggagtctgggggaggcttggtacagcctggcaggtccctgagactctcctgtgcagcctctggattcacctttgatgattattccatgcactgggtccggcaagctccagggaagggcctggagtgggtctcaggtattagttggaatagtcgtagcatagactatgcggactctgtgaagggccgattcaccatctccagagacaacgccaagaactccctgtatctgcaaatgaacagtctgagagctgaggacacggccttgtattactgtgtaaaagataatagtggctatggccgctattactactacgggatggacgtctggggccaagggaccacggtctccgtctcctca

SEQ ID NO: 738 - protein, 124 aa, Artificial Sequence
  synthetic
EVQLVESGGGLVQPGRSLRLSCAASGFTFDDYSMHWVRQAPGKGLEWVSGISWNSRSIDYADSVKGRFTISRDNAKNSLYLQMNSLRAEDTALYYCVKDNSGYGRYYYYGMDVWGQGTTVSVSS

SEQ ID NO: 739 - DNA, 24 bp, Artificial Sequence
  synthetic
ggattcacctttgatgattattcc

SEQ ID NO: 740 - protein, 8 aa, Artificial Sequence
  synthetic
GFTFDDYS

SEQ ID NO: 741 - DNA, 24 bp, Artificial Sequence
  synthetic
attagttggaatagtcgtagcata

SEQ ID NO: 742 - protein, 8 aa, Artificial Sequence
  synthetic
ISWNSRSI

SEQ ID NO: 743 - DNA, 51 bp, Artificial Sequence
  synthetic
gtaaaagataatagtggctatggccgctattactactacgggatggacgtc

SEQ ID NO: 744 - protein, 17 aa, Artificial Sequence
  synthetic
VKDNSGYGRYYYYGMDV

SEQ ID NO: 745 - DNA, 321 bp, Artificial Sequence
  synthetic
aaaatagtgatgacgcagtctcccgccaccctgtctgtgtctccaggggaaagagccaccctctcctgcagggccagtcagagtgttagcggcaacttagcctggtaccagcaaaaacctggccaggctcccaggctcctcatctatggtgcatccaccagggccactagtatcccagccaggttcagtggcagtgggtctgggacagagttcactctcaccatcagcagcctgcagtctgaagattttgcagtttatttctgtcagcactattataactggcctctcactttcggcggagggaccaaggtggagatcaga

SEQ ID NO: 746 - protein, 107 aa, Artificial Sequence
  synthetic
KIVMTQSPATLSVSPGERATLSCRASQSVSGNLAWYQQKPGQAPRLLIYGASTRATSIPARFSGSGSGTEFTLTISSLQSEDFAVYFCQHYYNWPLTFGGGTKVEIR

SEQ ID NO: 747 - DNA, 18 bp, Artificial Sequence
  synthetic
cagagtgttagcggcaac

SEQ ID NO: 748 - protein, 6 aa, Artificial Sequence
  synthetic
QSVSGN

SEQ ID NO: 749 - DNA, 9 bp, Artificial Sequence
  synthetic
ggtgcatcc

SEQ ID NO: 750 - protein, 3 aa, Artificial Sequence
  synthetic
GAS

SEQ ID NO: 751 - DNA, 27 bp, Artificial Sequence
  synthetic
cagcactattataactggcctctcact

SEQ ID NO: 752 - protein, 9 aa, Artificial Sequence
  synthetic
QHYYNWPLT

SEQ ID NO: 753 - DNA, 369 bp, Artificial Sequence; identical to SEQ ID NO: 401
  synthetic

SEQ ID NO: 754 - protein, 123 aa, Artificial Sequence; identical to SEQ ID NO: 402
  synthetic

SEQ ID NO: 755 - DNA, 24 bp, Artificial Sequence
  synthetic
ggattcacctttgatgattttacc

SEQ ID NO: 756 - protein, 8 aa, Artificial Sequence
  synthetic
GFTFDDFT

SEQ ID NO: 757 - DNA, 24 bp, Artificial Sequence
  synthetic
atcagttggaatagtggtagcata

SEQ ID NO: 758 - protein, 8 aa, Artificial Sequence
  synthetic
ISWNSGSI

SEQ ID NO: 759 - DNA, 48 bp, Artificial Sequence; identical to SEQ ID NO: 407
  synthetic

SEQ ID NO: 760 - protein, 16 aa, Artificial Sequence
  synthetic
AKDNSGYGYYYYGMDV

SEQ ID NO: 761 - DNA, 339 bp, Artificial Sequence
  synthetic
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaagctggagatcaaa

SEQ ID NO: 762 - protein, 113 aa, Artificial Sequence
  synthetic
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEIK

SEQ ID NO: 763 - DNA, 36 bp, Artificial Sequence
  synthetic
cagagtgttttatacagctccaacaataagaactac

SEQ ID NO: 764 - protein, 12 aa, Artificial Sequence
  synthetic
QSVLYSSNNKNY

SEQ ID NO: 765 - DNA, 9 bp, Artificial Sequence
  synthetic
tgggcatct

SEQ ID NO: 766 - protein, 3 aa, Artificial Sequence
  synthetic
WAS

SEQ ID NO: 767 - DNA, 27 bp, Artificial Sequence
  synthetic
cagcaatattatagtactccgtacact

SEQ ID NO: 768 - protein, 9 aa, Artificial Sequence
  synthetic
QQYYSTPYT

SEQ ID NO: 769 - DNA, 369 bp, Artificial Sequence
  synthetic
caggtcaccttgaaggagtctggtcctgcgctggtgaaacccacacagaccctcacactgacctgcaccttctctgggttctcactcagcactagtggaatgtgtgtgagctggatccgtcagcccccagggaaggccctggagtggcttgcacgcattgattgggatgatgataaatactacagcacatctctgaagaccaggctcaccatctccaaggacacctccaaaaaccaggtggtccttacaatgaccaacatggaccctgtggacacagccacgtattactgtgcacggatggatatagtgggagctagaggggggtggttcgacccctggggccagggaaccctggtcaccgtctcctca

SEQ ID NO: 770 - protein, 123 aa, Artificial Sequence
  synthetic
QVTLKESGPALVKPTQTLTLTCTFSGFSLSTSGMCVSWIRQPPGKALEWLARIDWDDDKYYSTSLKTRLTISKDTSKNQVVLTMTNMDPVDTATYYCARMDIVGARGGWFDPWGQGTLVTVSS

SEQ ID NO: 771 - DNA, 30 bp, Artificial Sequence
  synthetic
gggttctcactcagcactagtggaatgtgt

SEQ ID NO: 772 - protein, 10 aa, Artificial Sequence
  synthetic
GFSLSTSGMC

SEQ ID NO: 773 - DNA, 21 bp, Artificial Sequence
  synthetic
attgattgggatgatgataaa

SEQ ID NO: 774 - protein, 7 aa, Artificial Sequence
  synthetic
IDWDDDK

SEQ ID NO: 775 - DNA, 45 bp, Artificial Sequence
  synthetic
gcacggatggatatagtgggagctagaggggggtggttcgacccc

SEQ ID NO: 776 - protein, 15 aa, Artificial Sequence
  synthetic
ARMDIVGARGGWFDP

SEQ ID NO: 777 - DNA, 321 bp, Artificial Sequence
  synthetic
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtataatagttacccgctcactttcggcggagggaccaaggtggagatcaaa

SEQ ID NO: 778 - protein, 107 aa, Artificial Sequence
  synthetic
DIQMTQSPSSLSASVGDRVTITCRASQGISNYLAWFQQKPGKAPKSLIYAASSLQSGVPSKFSGSGSGTDFTLTISSLQPEDFATYYCQQYNSYPLTFGGGTKVEIK

SEQ ID NO: 779 - DNA, 18 bp, Artificial Sequence
  synthetic
cagggcattagcaattat

SEQ ID NO: 780 - protein, 6 aa, Artificial Sequence
  synthetic
QGISNY

SEQ ID NO: 781 - DNA, 9 bp, Artificial Sequence
  synthetic
gctgcatcc

SEQ ID NO: 782 - protein, 3 aa, Artificial Sequence
  synthetic
AAS

SEQ ID NO: 783 - DNA, 27 bp, Artificial Sequence
  synthetic
caacagtataatagttacccgctcact

SEQ ID NO: 784 - protein, 9 aa, Artificial Sequence
  synthetic
QQYNSYPLT

SEQ ID NO: 785 - DNA, 404 bp, Artificial Sequence
  synthetic
caggtgcagttggtggagtctgggggaggcgtggtccagcctgggaggtccctgagactctcctgtgctgcgtctggattcaccttcagaagttatggcatgcactgggtccgccaggctccaggcaaggggctggagtgggtggcaatgatatattatgatggaaataataaaaagtatgcagactccgtgaggggccgattcaccatttccagagacaattccaagaacacgctgtatctgcaaatgaacagcctgagagtcgaggacacggctgtgtatttctgtgcgcgagggcctgggtacaactggctcgacccctggggccagggaaccctggtcaccgtctcctcagccaaaacaacagccccacccgtttatccactggcccctggaagcttggg

SEQ ID NO: 786 - protein, 134 aa, Artificial Sequence
  synthetic
QVQLVESGGGVVQPGRSLRLSCAASGFTFRSYGMHWVRQAPGKGLEWVAMIYYDGNNKKYADSVRGRFTISRDNSKNTLYLQMNSLRVEDTAVYFCARGPGYNWLDPWGQGTLVTVSSAKTTAPPVYPLAPGSL

SEQ ID NO: 787 - DNA, 24 bp, Artificial Sequence
  synthetic
ggattcaccttcagaagttatggc

SEQ ID NO: 788 - protein, 8 aa, Artificial Sequence
  synthetic
GFTFRSYG

SEQ ID NO: 789 - DNA, 24 bp, Artificial Sequence
  synthetic
atatattatgatggaaataataaa

SEQ ID NO: 790 - protein, 8 aa, Artificial Sequence
  synthetic
IYYDGNNK

SEQ ID NO: 791 - DNA, 33 bp, Artificial Sequence; identical to SEQ ID NO: 551
  synthetic

SEQ ID NO: 792 - protein, 11 aa, Artificial Sequence
  synthetic
ARGPGYNWLDP

SEQ ID NO: 793 - DNA, 321 bp, Artificial Sequence
  synthetic
gaaatagtgatgacgcagtctccagccaccctgtctgtgtctccaggggaaagagccaccctctcctgcagggccagtcagagtgttagcaggaacttggcctggtaccagcagaaacctggccaggctcccaggctcctcatctatggtgcatccaccagggccactgatatcccagccaggttcagtggcagtgggtctgggacagagttcattctcaacatcagcagcctgcagtctgaagattttgcactttattactgtcaacaatatagtaactggcctctcactttcggcggagggaccgaggtggagatcaaa

SEQ ID NO: 794 - protein, 107 aa, Artificial Sequence
  synthetic
EIVMTQSPATLSVSPGERATLSCRASQSVSRNLAWYQQKPGQAPRLLIYGASTRATDIPARFSGSGSGTEFILNISSLQSEDFALYYCQQYSNWPLTFGGGTEVEIK

SEQ ID NO: 795 - DNA, 18 bp, Artificial Sequence
  synthetic
cagagtgttagcaggaac

SEQ ID NO: 796 - protein, 6 aa, Artificial Sequence
  synthetic
QSVSRN

SEQ ID NO: 797 - DNA, 9 bp, Artificial Sequence
  synthetic
ggtgcatcc

SEQ ID NO: 798 - protein, 3 aa, Artificial Sequence
  synthetic
GAS

SEQ ID NO: 799 - DNA, 27 bp, Artificial Sequence
  synthetic
caacaatatagtaactggcctctcact

SEQ ID NO: 800 - protein, 9 aa, Artificial Sequence
  synthetic
QQYSNWPLT

SEQ ID NO: 801 - DNA, 354 bp, Artificial Sequence; identical to SEQ ID NO: 689
  synthetic

SEQ ID NO: 802 - protein, 118 aa, Artificial Sequence; identical to SEQ ID NO: 610
  synthetic

SEQ ID NO: 803 - DNA, 24 bp, Artificial Sequence
  synthetic
ggtttcaccttcagaagttttggc

SEQ ID NO: 804 - protein, 8 aa, Artificial Sequence
  synthetic
GFTFRSFG

SEQ ID NO: 805 - DNA, 24 bp, Artificial Sequence
  synthetic
atatattttgatggaaaaaataaa

SEQ ID NO: 806 - protein, 8 aa, Artificial Sequence
  synthetic
IYFDGKNK

SEQ ID NO: 807 - DNA, 33 bp, Artificial Sequence; identical to SEQ ID NO: 551
  synthetic

SEQ ID NO: 808 - protein, 11 aa, Artificial Sequence
  synthetic
ARGPGYNWLDP

SEQ ID NO: 809 - DNA, 321 bp, Artificial Sequence
  synthetic
gaaatagtgatgacgcagtctccagccaccctgtctgtgtctccaggggaaagagtcatcctctcctgtagggccagtcagagtattagcaggaacttggcctggtaccagcagaaacctggccaggctcccaggctcctcatctatggtgcaaccaccagggccactggtgtcccagccaggttcagtggcagtgggtctgggacagagttcactctcaccatcagcagcctacagtctgaagattttgcagttttttactgtcagcagtataataataggcctctcactttcggcggagggaccgaggtggagatcaaa

SEQ ID NO: 810 - protein, 107 aa, Artificial Sequence; identical to SEQ ID NO: 698
  synthetic

SEQ ID NO: 811 - DNA, 18 bp, Artificial Sequence
  synthetic
cagagtattagcaggaac

SEQ ID NO: 812 - protein, 6 aa, Artificial Sequence
  synthetic
QSISRN

SEQ ID NO: 813 - DNA, 9 bp, Artificial Sequence
  synthetic
ggtgcaacc

SEQ ID NO: 814 - protein, 3 aa, Artificial Sequence
  synthetic
GAT

SEQ ID NO: 815 - DNA, 27 bp, Artificial Sequence
  synthetic
cagcagtataataataggcctctcact

SEQ ID NO: 816 - protein, 9 aa, Artificial Sequence
  synthetic
QQYNNRPLT

SEQ ID NO: 817 - DNA, 354 bp, Artificial Sequence; identical to SEQ ID NO: 689
  synthetic

SEQ ID NO: 818 - protein, 118 aa, Artificial Sequence; identical to SEQ ID NO: 610
  synthetic

SEQ ID NO: 819 - DNA, 24 bp, Artificial Sequence
  synthetic
ggtttcaccttcagaagttttggc

SEQ ID NO: 820 - protein, 8 aa, Artificial Sequence
  synthetic
GFTFRSFG

SEQ ID NO: 821 - DNA, 24 bp, Artificial Sequence
  synthetic
atatattttgatggaaaaaataaa

SEQ ID NO: 822 - protein, 8 aa, Artificial Sequence
  synthetic
IYFDGKNK

SEQ ID NO: 823 - DNA, 33 bp, Artificial Sequence; identical to SEQ ID NO: 551
  synthetic

SEQ ID NO: 824 - protein, 11 aa, Artificial Sequence
  synthetic
ARGPGYNWLDP

SEQ ID NO: 825 - DNA, 321 bp, Artificial Sequence; identical to SEQ ID NO: 809
  synthetic

SEQ ID NO: 826 - protein, 107 aa, Artificial Sequence; identical to SEQ ID NO: 698
  synthetic

SEQ ID NO: 827 - DNA, 18 bp, Artificial Sequence
  synthetic
cagagtattagcaggaac

SEQ ID NO: 828 - protein, 6 aa, Artificial Sequence
  synthetic
QSISRN

SEQ ID NO: 829 - DNA, 9 bp, Artificial Sequence
  synthetic
ggtgcaacc

SEQ ID NO: 830 - protein, 3 aa, Artificial Sequence
  synthetic
GAT

SEQ ID NO: 831 - DNA, 27 bp, Artificial Sequence
  synthetic
cagcagtataataataggcctctcact

SEQ ID NO: 832 - protein, 9 aa, Artificial Sequence
  synthetic
QQYNNRPLT

SEQ ID NO: 833 - DNA, 351 bp, Artificial Sequence
  synthetic
caggtgcacctggaagagtctgggggaggcgtggtccagcctgggaggtccctgagactctcctgttcagcgtctggtttcaccttcagtagttatgccatgcactgggtccgccaggctccaggcaaggggctggagtgggtggcagttatatggtatgatggaactaataaatattatttagattccgtgaagggccgattcaccatctccagagacaattccaagaacacgctgtttctgcaaatgaacagcctgagagccgaagacacggctgtgtattactgtgcgagagatcggggaagtataataacccactggggccagggaaccctggtcaccgtctcctca

SEQ ID NO: 834 - protein, 117 aa, Artificial Sequence
  synthetic
QVHLEESGGGVVQPGRSLRLSCSASGFTFSSYAMHWVRQAPGKGLEWVAVIWYDGTNKYYLDSVKGRFTISRDNSKNTLFLQMNSLRAEDTAVYYCARDRGSIITHWGQGTLVTVSS

SEQ ID NO: 835 - DNA, 24 bp, Artificial Sequence
  synthetic
ggtttcaccttcagtagttatgcc

SEQ ID NO: 836 - protein, 8 aa, Artificial Sequence
  synthetic
GFTFSSYA

SEQ ID NO: 837 - DNA, 24 bp, Artificial Sequence
  synthetic
atatggtatgatggaactaataaa

SEQ ID NO: 838 - protein, 8 aa, Artificial Sequence
  synthetic
IWYDGTNK

SEQ ID NO: 839 - DNA, 30 bp, Artificial Sequence
  synthetic
gcgagagatcggggaagtataataacccac

SEQ ID NO: 840 - protein, 10 aa, Artificial Sequence
  synthetic
ARDRGSIITH

SEQ ID NO: 841 - DNA, 324 bp, Artificial Sequence
  synthetic
gacatccagatgacccagtctccatcctccctgtctgcatctataggagacagagtcaccatcacttgccgggcaagtcagaacattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagacttacagtacccctccgatcaccttcggccaagggacacgactggagattaaa

SEQ ID NO: 842 - protein, 108 aa, Artificial Sequence
  synthetic
DIQMTQSPSSLSASIGDRVTITCRASQNISSYLNWYQQKPGKAPKLLIYAASSLQSGVPSRFSGSGSGTDFTLTISSLQPEDFATYYCQQTYSTPPITFGQGTRLEIK

SEQ ID NO: 843 - DNA, 18 bp, Artificial Sequence
  synthetic
cagaacattagcagctat

SEQ ID NO: 844 - protein, 6 aa, Artificial Sequence
  synthetic
QNISSY

SEQ ID NO: 845 - DNA, 9 bp, Artificial Sequence
  synthetic
gctgcatcc

SEQ ID NO: 846 - protein, 3 aa, Artificial Sequence
  synthetic
AAS

SEQ ID NO: 847 - DNA, 30 bp, Artificial Sequence
  synthetic
caacagacttacagtacccctccgatcacc

SEQ ID NO: 848 - protein, 10 aa, Artificial Sequence
  synthetic
QQTYSTPPIT

SEQ ID NO: 849 - DNA, 372 bp, Artificial Sequence
  synthetic
gaagtacagctggtggagtctgggggaggcttggtacggcctggcaggtccctgagactctcctgtgcagcctctggattcacctttgatgattataccatgcactgggtccgccaagctccagggaagggcctggagtgggtctcagatattagttggaatagtgggaccataggctatgcggactctgtgaagggccgattcaccatctccagagacaacgccaagaactccctgtatctgcaaatgaacagtctgagacctgaggacacggccttgtattactgtgcaaaagatatgagtggctacgcccactactactactacggtatggacgtctggggccaagggaccacggtcaccgtctcctca

SEQ ID NO: 850 - protein, 124 aa, Artificial Sequence
  synthetic
EVQLVESGGGLVRPGRSLRLSCAASGFTFDDYTMHWVRQAPGKGLEWVSDISWNSGTIGYADSVKGRFTISRDNAKNSLYLQMNSLRPEDTALYYCAKDMSGYAHYYYYGMDVWGQGTTVTVSS

SEQ ID NO: 851 - DNA, 24 bp, Artificial Sequence
  synthetic
ggattcacctttgatgattatacc

SEQ ID NO: 852 - protein, 8 aa, Artificial Sequence
  synthetic
GFTFDDYT

SEQ ID NO: 853 - DNA, 24 bp, Artificial Sequence
  synthetic
attagttggaatagtgggaccata

SEQ ID NO: 854 - protein, 8 aa, Artificial Sequence
  synthetic
ISWNSGTI

SEQ ID NO: 855 - DNA, 51 bp, Artificial Sequence
  synthetic
gcaaaagatatgagtggctacgcccactactactactacggtatggacgtc

SEQ ID NO: 856 - protein, 17 aa, Artificial Sequence
  synthetic
AKDMSGYAHYYYYGMDV

SEQ ID NO: 857 - DNA, 324 bp, Artificial Sequence
  synthetic
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 858 - protein, 108 aa, Artificial Sequence; identical to SEQ ID NO: 58
  synthetic

SEQ ID NO: 859 - DNA, 18 bp, Artificial Sequence
  synthetic
cagagcattagcagctat

SEQ ID NO: 860 - protein, 6 aa, Artificial Sequence
  synthetic
QSISSY

SEQ ID NO: 861 - DNA, 9 bp, Artificial Sequence
  synthetic
gctgcatcc

SEQ ID NO: 862 - protein, 3 aa, Artificial Sequence
  synthetic
AAS

SEQ ID NO: 863 - DNA, 30 bp, Artificial Sequence; identical to SEQ ID NO: 15
  synthetic

SEQ ID NO: 864 - protein, 10 aa, Artificial Sequence
  synthetic
QQSYSTPPIT

SEQ ID NO: 865 - DNA, 372 bp, Artificial Sequence
  synthetic
gaagtgcagctggtggagtctgggggaggcttggtacagcctggcaggtccctgagactctcctgtgcagcctctggattcacctttgatgattataccatgcactgggtccggcaagctccagggaagggcctggagtgggtctccgatattagttggaatagtggtagcataggctatgcggactctgtgaagggccgattcaccgtctccagagacaacgccaagaactccctgtatctgcaaatgaacagtctgagaggtgaggacacggccctgtattactgtgcaaaagatatgagtggctacgcccactacggctactacggtatggacgtctggggccaagggaccacggtcaccgtctcctca

SEQ ID NO: 866 - protein, 124 aa, Artificial Sequence
  synthetic
EVQLVESGGGLVQPGRSLRLSCAASGFTFDDYTMHWVRQAPGKGLEWVSDISWNSGSIGYADSVKGRFTVSRDNAKNSLYLQMNSLRGEDTALYYCAKDMSGYAHYGYYGMDVWGQGTTVTVSS

SEQ ID NO: 867 - DNA, 24 bp, Artificial Sequence
  synthetic
ggattcacctttgatgattatacc

SEQ ID NO: 868 - protein, 8 aa, Artificial Sequence
  synthetic
GFTFDDYT

SEQ ID NO: 869 - DNA, 24 bp, Artificial Sequence
  synthetic
attagttggaatagtggtagcata

SEQ ID NO: 870 - protein, 8 aa, Artificial Sequence
  synthetic
ISWNSGSI

SEQ ID NO: 871 - DNA, 51 bp, Artificial Sequence
  synthetic
gcaaaagatatgagtggctacgcccactacggctactacggtatggacgtc

SEQ ID NO: 872 - protein, 17 aa, Artificial Sequence
  synthetic
AKDMSGYAHYGYYGMDV

SEQ ID NO: 873 - DNA, 324 bp, Artificial Sequence
  synthetic
gacatccagatgacccagtctccatcctccctgtctgcatctgtaggagacagagtcaccatcacttgccgggcaagtcagagcattaggaactatttaaattggtatcagcagaaaccagggaaagtccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaaccctccgatcaccttcggccaagggacacgactggagattaaa

SEQ ID NO: 874 - protein, 108 aa, Artificial Sequence
  synthetic
DIQMTQSPSSLSASVGDRVTITCRASQSIRNYLNWYQQKPGKVPKLLIYAASSLQSGVPSRFSGSGSGTDFTLTISSLQPEDFATYYCQQSYSNPPITFGQGTRLEIK

SEQ ID NO: 875 - DNA, 18 bp, Artificial Sequence
  synthetic
cagagcattaggaactat

SEQ ID NO: 876 - protein, 6 aa, Artificial Sequence
  synthetic
QSIRNY

SEQ ID NO: 877 - DNA, 9 bp, Artificial Sequence
  synthetic
gctgcatcc

SEQ ID NO: 878 - protein, 3 aa, Artificial Sequence
  synthetic
AAS

SEQ ID NO: 879 - DNA, 30 bp, Artificial Sequence
  synthetic
caacagagttacagtaaccctccgatcacc

SEQ ID NO: 880 - protein, 10 aa, Artificial Sequence
  synthetic
QQSYSNPPIT

SEQ ID NO: 881 - DNA, 369 bp, Artificial Sequence
  synthetic
gaagcgcagctggtggaatctgggggaggcttggtacagcctggcaggtccctgagactctcctgtacaacctctggattcacctttgatgattataccatgcactgggtccggcaagctccagggaagggcctggagtggatctctgatattagttggaatggtggaaccaaaggctatgcggactctgtgaagggccgattcaccatctccagagacaacgccaaaaactccctgtatctgcaaatggacagtctgagaggtgaggacacggccttatattactgtgtaaaagataaaagtggctacgggcacttctacttcggtttggacgtctggggccaagggaccacggtcaccgtctcctca

SEQ ID NO: 882 - protein, 123 aa, Artificial Sequence
  synthetic
EAQLVESGGGLVQPGRSLRLSCTTSGFTFDDYTMHWVRQAPGKGLEWISDISWNGGTKGYADSVKGRFTISRDNAKNSLYLQMDSLRGEDTALYYCVKDKSGYGHFYFGLDVWGQGTTVTVSS

SEQ ID NO: 883 - DNA, 24 bp, Artificial Sequence
  synthetic
ggattcacctttgatgattatacc

SEQ ID NO: 884 - protein, 8 aa, Artificial Sequence
  synthetic
GFTFDDYT

SEQ ID NO: 885 - DNA, 24 bp, Artificial Sequence
  synthetic
attagttggaatggtggaaccaaa

SEQ ID NO: 886 - protein, 8 aa, Artificial Sequence
  synthetic
ISWNGGTK

SEQ ID NO: 887 - DNA, 48 bp, Artificial Sequence
  synthetic
gtaaaagataaaagtggctacgggcacttctacttcggtttggacgtc

SEQ ID NO: 888 - protein, 16 aa, Artificial Sequence
  synthetic
VKDKSGYGHFYFGLDV

SEQ ID NO: 889 - DNA, 324 bp, Artificial Sequence
  synthetic
gacatccagatgacccagtctccatcctccctgactgcgtctgtaggagacagagtcaccttcacttgccgggcaagtcagagcattagcaggcatttaagttggtatcagcagaaaccagggaaagcccctaagctcctgatctatgctgcatccagtttggaaagtggggtcccttcaaggttcagtggcagtggatctgggacagatttcactctcaccatcagcagtctgcaccctgaagattttgcaacttactactgtcaacagagctacagtaaccctccgatcaccttcggccaagggacacgactggagattaaa

SEQ ID NO: 890 - protein, 108 aa, Artificial Sequence
  synthetic
DIQMTQSPSSLTASVGDRVTFTCRASQSISRHLSWYQQKPGKAPKLLIYAASSLESGVPSRFSGSGSGTDFTLTISSLHPEDFATYYCQQSYSNPPITFGQGTRLEIK

SEQ ID NO: 891 - DNA, 18 bp, Artificial Sequence
  synthetic
cagagcattagcaggcat

SEQ ID NO: 892 - protein, 6 aa, Artificial Sequence
  synthetic
QSISRH

SEQ ID NO: 893 - DNA, 9 bp, Artificial Sequence
  synthetic
gctgcatcc

SEQ ID NO: 894 - protein, 3 aa, Artificial Sequence
  synthetic
AAS

SEQ ID NO: 895 - DNA, 30 bp, Artificial Sequence
  synthetic
caacagagctacagtaaccctccgatcacc

SEQ ID NO: 896 - protein, 10 aa, Artificial Sequence
  synthetic
QQSYSNPPIT

SEQ ID NO: 897 - DNA, 369 bp, Artificial Sequence
  synthetic
gaagtgcagttggtggagtctgggggaggcttggtacagcctggcaggtccctgagactctcctgtgcagcctctggattcaagtttgctgattatgccatgcactgggtccggcaagctccagggaagggcctggagtgggtctcagagattagttggaatagtggtagcataggttatgtggactctgtgaagggccgattcaccatctccagagacaacgccaagaactccctgtatctgcaaatgaacagtctgagagctgaggacacggccttgtattactgtgtaaaagataaaagtggctacgggcactactatatcggtatggacgtctggggccaagggaccacggtcatcgtctcctcc

SEQ ID NO: 898 - protein, 123 aa, Artificial Sequence
  synthetic
EVQLVESGGGLVQPGRSLRLSCAASGFKFADYAMHWVRQAPGKGLEWVSEISWNSGSIGYVDSVKGRFTISRDNAKNSLYLQMNSLRAEDTALYYCVKDKSGYGHYYIGMDVWGQGTTVIVSS

SEQ ID NO: 899 - DNA, 24 bp, Artificial Sequence
  synthetic
ggattcaagtttgctgattatgcc

SEQ ID NO: 900 - protein, 8 aa, Artificial Sequence
  synthetic
GFKFADYA

SEQ ID NO: 901 - DNA, 24 bp, Artificial Sequence
  synthetic
attagttggaatagtggtagcata

SEQ ID NO: 902 - protein, 8 aa, Artificial Sequence
  synthetic
ISWNSGSI

SEQ ID NO: 903 - DNA, 48 bp, Artificial Sequence
  synthetic
gtaaaagataaaagtggctacgggcactactatatcggtatggacgtc

SEQ ID NO: 904 - protein, 16 aa, Artificial Sequence
  synthetic
VKDKSGYGHYYIGMDV

SEQ ID NO: 905 - DNA, 324 bp, Artificial Sequence
  synthetic
gacatccagatgacccagtctccatcctccctgtctgcatctgtaggagacagagtcaccatcacttgccgggcaagtcagagtattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 906 - protein, 108 aa, Artificial Sequence; identical to SEQ ID NO: 58
  synthetic

SEQ ID NO: 907 - DNA, 18 bp, Artificial Sequence
  synthetic
cagagtattagcagctat

SEQ ID NO: 908 - protein, 6 aa, Artificial Sequence
  synthetic
QSISSY

SEQ ID NO: 909 - DNA, 9 bp, Artificial Sequence
  synthetic
gctgcatcc

SEQ ID NO: 910 - protein, 3 aa, Artificial Sequence
  synthetic
AAS

SEQ ID NO: 911 - DNA, 30 bp, Artificial Sequence; identical to SEQ ID NO: 15
  synthetic

SEQ ID NO: 912 - protein, 10 aa, Artificial Sequence
  synthetic
QQSYSTPPIT

SEQ ID NO: 913 - DNA, 372 bp, Artificial Sequence
  synthetic
gaagtgcacctggtggagtctgggggaggcttggtacagcctggcaggtccctgagactctcctgtgcagcctctggattcacctttgatgattataccatgcactgggtccggcaagctccagggaagggcctggagtgggtctccgatattagttggaatagtggtagcataggctatgcggactctgtgaagggccgattcaccgtctccagagacaacgccaagaactccctgtatctgcaaatgaacagtctgagaggtgaggacacggccttgtattactgtgcaaaagatatgagtggctacggccactacggcaagtacggtatggacgtctggggccaagggaccacggtcaccgtctcctca

SEQ ID NO: 914 - protein, 124 aa, Artificial Sequence
  synthetic
EVHLVESGGGLVQPGRSLRLSCAASGFTFDDYTMHWVRQAPGKGLEWVSDISWNSGSIGYADSVKGRFTVSRDNAKNSLYLQMNSLRGEDTALYYCAKDMSGYGHYGKYGMDVWGQGTTVTVSS

SEQ ID NO: 915 - DNA, 24 bp, Artificial Sequence
  synthetic
ggattcacctttgatgattatacc

SEQ ID NO: 916 - protein, 8 aa, Artificial Sequence
  synthetic
GFTFDDYT

SEQ ID NO: 917 - DNA, 24 bp, Artificial Sequence
  synthetic
attagttggaatagtggtagcata

SEQ ID NO: 918 - protein, 8 aa, Artificial Sequence
  synthetic
ISWNSGSI

SEQ ID NO: 919 - DNA, 51 bp, Artificial Sequence
  synthetic
gcaaaagatatgagtggctacggccactacggcaagtacggtatggacgtc

SEQ ID NO: 920 - protein, 17 aa, Artificial Sequence
  synthetic
AKDMSGYGHYGKYGMDV

SEQ ID NO: 921 - DNA, 324 bp, Artificial Sequence
  synthetic
gacatccagatgacccagtctccatcctccctgtctgcatctgtaggagacagagtcaccatcacttgccgggcaagtcagagcattaggagctatttaaattggtatcagcagaaaccagggaaagtccctaagctcctgatctatgctgcatccagtttgcaaagtggggtcccatcaaggttcagtggcagtggatctgggacagatttcactctcaccatcaacagtctgcaacctgacgattttgcaacttactactgtcaacagacttacagtaaccctccgatcaccttcggccaagggacacgactggagattaaa

SEQ ID NO: 922 - protein, 108 aa, Artificial Sequence
  synthetic
DIQMTQSPSSLSASVGDRVTITCRASQSIRSYLNWYQQKPGKVPKLLIYAASSLQSGVPSRFSGSGSGTDFTLTINSLQPDDFATYYCQQTYSNPPITFGQGTRLEIK

SEQ ID NO: 923 - DNA, 18 bp, Artificial Sequence
  synthetic
cagagcattaggagctat

SEQ ID NO: 924 - protein, 6 aa, Artificial Sequence
  synthetic
QSIRSY

SEQ ID NO: 925 - DNA, 9 bp, Artificial Sequence
  synthetic
gctgcatcc

SEQ ID NO: 926 - protein, 3 aa, Artificial Sequence
  synthetic
AAS

SEQ ID NO: 927 - DNA, 30 bp, Artificial Sequence
  synthetic
caacagacttacagtaaccctccgatcacc

SEQ ID NO: 928 - protein, 10 aa, Artificial Sequence
  synthetic
QQTYSNPPIT

SEQ ID NO: 929 - DNA, 372 bp, Artificial Sequence
  synthetic
gaggtgcagctggtggagtctgggggagacttggtacagcctggcaggtccctgagactctcctgtgcagcctctggattcacctttgatgattataccatgcactgggtccggcaagctccagggaagggcctggagtgggtctcaattattagttggaatggtaataccattgactatgcggactctgtgaagggccgattcaccatctccagagacaacgccaagaactccctgtatcttcaaatgaacagtctgagagctgaggacacggccttgtattactgtgcaaaagataagagtggctacggacacttctactattacgttttggacgtctggggccaagggaccacggtcaccgtctcctca

SEQ ID NO: 930 - protein, 124 aa, Artificial Sequence
  synthetic
EVQLVESGGDLVQPGRSLRLSCAASGFTFDDYTMHWVRQAPGKGLEWVSIISWNGNTIDYADSVKGRFTISRDNAKNSLYLQMNSLRAEDTALYYCAKDKSGYGHFYYYVLDVWGQGTTVTVSS

SEQ ID NO: 931 - DNA, 24 bp, Artificial Sequence
  synthetic
ggattcacctttgatgattatacc

SEQ ID NO: 932 - protein, 8 aa, Artificial Sequence
  synthetic
GFTFDDYT

SEQ ID NO: 933 - DNA, 24 bp, Artificial Sequence
  synthetic
attagttggaatggtaataccatt

SEQ ID NO: 934 - protein, 8 aa, Artificial Sequence
  synthetic
ISWNGNTI

SEQ ID NO: 935 - DNA, 51 bp, Artificial Sequence
  synthetic
gcaaaagataagagtggctacggacacttctactattacgttttggacgtc

SEQ ID NO: 936 - protein, 17 aa, Artificial Sequence
  synthetic
AKDKSGYGHFYYYVLDV

SEQ ID NO: 937 - DNA, 321 bp, Artificial Sequence
  synthetic
gacatccagatgacccagtctccatcctccctgtctgcatctgtaggagacagagtcaccatcacttgccgggcaagtcagagcattaacaactatttaaattggtatcagcagaaaccagggaaagcccctaaactcctgatctatgctgcttccagtttgcaaagtggggtcccgtcaaggttcagtggcagtggttctgggacagatttcactctcaccatcagcagtctgcaacctgaagattttgcaacttactactctcaacagagttacagtttcccgtggacgttcggccaagggaccaaggtggaaatcaaa

SEQ ID NO: 938 - protein, 107 aa, Artificial Sequence
  synthetic
DIQMTQSPSSLSASVGDRVTITCRASQSINNYLNWYQQKPGKAPKLLIYAASSLQSGVPSRFSGSGSGTDFTLTISSLQPEDFATYYSQQSYSFPWTFGQGTKVEIK

SEQ ID NO: 939 - DNA, 18 bp, Artificial Sequence
  synthetic
cagagcattaacaactat

SEQ ID NO: 940 - protein, 6 aa, Artificial Sequence
  synthetic
QSINNY

SEQ ID NO: 941 - DNA, 9 bp, Artificial Sequence
  synthetic
gctgcttcc

SEQ ID NO: 942 - protein, 3 aa, Artificial Sequence
  synthetic
AAS

SEQ ID NO: 943 - DNA, 27 bp, Artificial Sequence
  synthetic
caacagagttacagtttcccgtggacg

SEQ ID NO: 944 - protein, 9 aa, Artificial Sequence
  synthetic
QQSYSFPWT

SEQ ID NO: 945 - DNA, 363 bp, Artificial Sequence
  synthetic
caggtgcagctggtggagtcggggggaggcgtggtccagcctgggaggtccctgagaccctcctgtgcagcgtctggatttagtttcagggactatggcatgcactgggtccgccaggctccaggtaagggactagagtggatggcacacatatggtataatggaaagaataaatattatgcagactccgtgaagggccgattcaccatctccagagacaattccaagaacacgctatatctgcaaatgaacagcctgagacccgaggacacggctgtatattattgtgcgagagatggtgtatcagcacgtggtactccatttgactactggggccagggaaccctggtcaccgtctcctca

SEQ ID NO: 946 - protein, 121 aa, Artificial Sequence
  synthetic
QVQLVESGGGVVQPGRSLRPSCAASGFSFRDYGMHWVRQAPGKGLEWMAHIWYNGKNKYYADSVKGRFTISRDNSKNTLYLQMNSLRPEDTAVYYCARDGVSARGTPFDYWGQGTLVTVSS

SEQ ID NO: 947 - DNA, 24 bp, Artificial Sequence
  synthetic
ggatttagtttcagggactatggc

SEQ ID NO: 948 - protein, 8 aa, Artificial Sequence
  synthetic
GFSFRDYG

SEQ ID NO: 949 - DNA, 24 bp, Artificial Sequence
  synthetic
atatggtataatggaaagaataaa

SEQ ID NO: 950 - protein, 8 aa, Artificial Sequence
  synthetic
IWYNGKNK

SEQ ID NO: 951 - DNA, 42 bp, Artificial Sequence
  synthetic
gcgagagatggtgtatcagcacgtggtactccatttgactac

SEQ ID NO: 952 - protein, 14 aa, Artificial Sequence
  synthetic
ARDGVSARGTPFDY

SEQ ID NO: 953 - DNA, 321 bp, Artificial Sequence
  synthetic
gaaacgacactcacgcagtctccagcattcatgtcagcggctccaggagacaaagtcagcatctcctgcattgccagccagtacattgatgatgatgtgaactggtaccaacagaaaccaggagaaactgctattttcattattcaagaagcttctactctcgttcctggaatctcacctcgattcagtggcagcgggtatggaacacattttaccctcacaattaataacatagattctgaggatgctgcattttacttctgtctccaacatgataatttcccgtacacttttggccaggggaccaagctggagatcaaa

SEQ ID NO: 954 - protein, 107 aa, Artificial Sequence
  synthetic
ETTLTQSPAFMSAAPGDKVSISCIASQYIDDDVNWYQQKPGETAIFIIQEASTLVPGISPRFSGSGYGTHFTLTINNIDSEDAAFYFCLQHDNFPYTFGQGTKLEIK

SEQ ID NO: 955 - DNA, 18 bp, Artificial Sequence
  synthetic
cagtacattgatgatgat

SEQ ID NO: 956 - protein, 6 aa, Artificial Sequence
  synthetic
QYIDDD

SEQ ID NO: 957 - DNA, 9 bp, Artificial Sequence
  synthetic
gaagcttct

SEQ ID NO: 958 - protein, 3 aa, Artificial Sequence
  synthetic
EAS

SEQ ID NO: 959 - DNA, 27 bp, Artificial Sequence
  synthetic
ctccaacatgataatttcccgtacact

SEQ ID NO: 960 - protein, 9 aa, Artificial Sequence
  synthetic
LQHDNFPYT

SEQ ID NO: 961 - DNA, 384 bp, Artificial Sequence
  synthetic
caggtgcagctggtggagtctgggggaggcttggtacagcctggggggtccctgagactctcctgtgcagcctcttatttcacctttagcagttttgccatgaactgggtccgccaggctccagggcagggcctggagtgggtctcagctattagtggtagggtctcagctattagtggtagtggtggtatcacatactacgcagactccgtgaagggccggttcatcatctccagagacaattccaagaacacgctgtatctgcaaatgagcggcctgagagccgaggacacggccgtatattactgtgcgaaaggcccctatttgactacagtcaccccctttgactactggggccagggaaccctggtcaccgtctcctca

SEQ ID NO: 962 - protein, 128 aa, Artificial Sequence
  synthetic
QVQLVESGGGLVQPGGSLRLSCAASYFTFSSFAMNWVRQAPGQGLEWVSAISGRVSAISGSGGITYYADSVKGRFIISRDNSKNTLYLQMSGLRAEDTAVYYCAKGPYLTTVTPFDYWGQGTLVTVSS

SEQ ID NO: 963 - DNA, 24 bp, Artificial Sequence
  synthetic
tatttcacctttagcagttttgcc

SEQ ID NO: 964 - protein, 8 aa, Artificial Sequence
  synthetic
YFTFSSFA

SEQ ID NO: 965 - DNA, 24 bp, Artificial Sequence
  synthetic
attagtggtagtggtggtatcaca

SEQ ID NO: 966 - protein, 8 aa, Artificial Sequence
  synthetic
ISGSGGIT

SEQ ID NO: 967 - DNA, 42 bp, Artificial Sequence
  synthetic
gcgaaaggcccctatttgactacagtcaccccctttgactac

SEQ ID NO: 968 - protein, 14 aa, Artificial Sequence
  synthetic
AKGPYLTTVTPFDY

SEQ ID NO: 969 - DNA, 324 bp, Artificial Sequence
  synthetic
gacatccagttgacccagtctccatcttccgtgtctgcatctgtcggagacagagtcaccatcacttgtcgggcgagtcaggggattagcagctggttagcctggtatcagcagaaaccagggaaagcccctaaactcctgatctatgctgtatccagtttgcaaaatggggtcccatcaaggttcagcggcagtggatctgggacagatttcaccctcaccatcagcagcctgcagcctgaagactttgcaacttactattgtcaacaggctaacagtttcccattcactttcggccctgggaccaagctggagatcaaacga

SEQ ID NO: 970 - protein, 108 aa, Artificial Sequence
  synthetic
DIQLTQSPSSVSASVGDRVTITCRASQGISSWLAWYQQKPGKAPKLLIYAVSSLQNGVPSRFSGSGSGTDFTLTISSLQPEDFATYYCQQANSFPFTFGPGTKLEIKR

SEQ ID NO: 971 - DNA, 18 bp, Artificial Sequence
  synthetic
caggggattagcagctgg

SEQ ID NO: 972 - protein, 6 aa, Artificial Sequence
  synthetic
QGISSW

SEQ ID NO: 973 - DNA, 9 bp, Artificial Sequence
  synthetic
gctgtatcc

SEQ ID NO: 974 - protein, 3 aa, Artificial Sequence
  synthetic
AVS

SEQ ID NO: 975 - DNA, 27 bp, Artificial Sequence
  synthetic
caacaggctaacagtttcccattcact

SEQ ID NO: 976 - protein, 9 aa, Artificial Sequence
  synthetic
QQANSFPFT

SEQ ID NO: 977 - DNA, 369 bp, Artificial Sequence
  synthetic
gaggtgcagctggtggagtctgggggaggcttggtacagcctggcaggtccctgagactctcctgtgcagcctctggattcacctttgctgattatgccatgcactgggtccggcaagctccagggaagggcctggagtgggtctcaggtattagttggaatagtggtagtataggttatgcggactctgtgaagggccgattcaccatctccagagacaacgccaagaactccctgtatctgcaaatgaacagtctgagagctgaggacacggccttatattactgtgtaaaagataatagtggctacgcatcctactactacggtatggacgtctggggccaagggaccacggtcaccgtctcctca

SEQ ID NO: 978 - protein, 123 aa, Artificial Sequence
  synthetic
EVQLVESGGGLVQPGRSLRLSCAASGFTFADYAMHWVRQAPGKGLEWVSGISWNSGSIGYADSVKGRFTISRDNAKNSLYLQMNSLRAEDTALYYCVKDNSGYASYYYGMDVWGQGTTVTVSS

SEQ ID NO: 979 - DNA, 24 bp, Artificial Sequence
  synthetic
ggattcacctttgctgattatgcc

SEQ ID NO: 980 - protein, 8 aa, Artificial Sequence
  synthetic
GFTFADYA

SEQ ID NO: 981 - DNA, 24 bp, Artificial Sequence
  synthetic
attagttggaatagtggtagtata

SEQ ID NO: 982 - protein, 8 aa, Artificial Sequence
  synthetic
ISWNSGSI

SEQ ID NO: 983 - DNA, 48 bp, Artificial Sequence
  synthetic
gtaaaagataatagtggctacgcatcctactactacggtatggacgtc

SEQ ID NO: 984 - protein, 16 aa, Artificial Sequence
  synthetic
VKDNSGYASYYYGMDV

SEQ ID NO: 985 - DNA, 324 bp, Artificial Sequence
  synthetic
gacatccagttgacccagtccccatcctccctgtctgcatctgtaggagacagagtcaccatcacttgccgggcaagtcagagcattagcagctatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccattcactttcggccctgggaccaaagtggatatcaaacga

SEQ ID NO: 986 - protein, 108 aa, Artificial Sequence
  synthetic
DIQLTQSPSSLSASVGDRVTITCRASQSISSYLNWYQQKPGKAPKLLIYDASNLETGVPSRFSGSGSGTDFTFTISSLQPEDIATYYCQQYDNLPFTFGPGTKVDIKR

SEQ ID NO: 987 - DNA, 18 bp, Artificial Sequence
  synthetic
cagagcattagcagctat

SEQ ID NO: 988 - protein, 6 aa, Artificial Sequence
  synthetic
QSISSY

SEQ ID NO: 989 - DNA, 9 bp, Artificial Sequence
  synthetic
gatgcatcc

SEQ ID NO: 990 - protein, 3 aa, Artificial Sequence
  synthetic
DAS

SEQ ID NO: 991 - DNA, 27 bp, Artificial Sequence
  synthetic
caacagtatgataatctcccattcact

SEQ ID NO: 992 - protein, 9 aa, Artificial Sequence
  synthetic
QQYDNLPFT

SEQ ID NO: 993 - DNA, 378 bp, Artificial Sequence
  synthetic
gaggtgcagctggtggagtctgggggaggcgtggtccagcctgggaggtccctgagactctcctgtgcagcctctggattcaccttcagtaactatggcatgcactgggtccgccaggctccaggcaaagggctggagtgggtgacagttatattacatgatggaagttataaatactatgcagactccgtgaagggccgattcaccatctccagagacaattccaagaacacgctacatctgcaaatgaacagcctgagaactgaggacacggctgtatattactgtgcgaaagggcctatgtttcggggagtcccttacaaccactactatggtatggacgtctggggccaagggaccacggtcaccgtctcctca

SEQ ID NO: 994 - protein, 126 aa, Artificial Sequence
  synthetic
EVQLVESGGGVVQPGRSLRLSCAASGFTFSNYGMHWVRQAPGKGLEWVTVILHDGSYKYYADSVKGRFTISRDNSKNTLHLQMNSLRTEDTAVYYCAKGPMFRGVPYNHYYGMDVWGQGTTVTVSS

SEQ ID NO: 995 - DNA, 24 bp, Artificial Sequence
  synthetic
ggattcaccttcagtaactatggc

SEQ ID NO: 996 - protein, 8 aa, Artificial Sequence
  synthetic
GFTFSNYG

SEQ ID NO: 997 - DNA, 24 bp, Artificial Sequence
  synthetic
atattacatgatggaagttataaa

SEQ ID NO: 998 - protein, 8 aa, Artificial Sequence
  synthetic
ILHDGSYK

SEQ ID NO: 999 - DNA, 57 bp, Artificial Sequence
  synthetic
gcgaaagggcctatgtttcggggagtcccttacaaccactactatggtatggacgtc

SEQ ID NO: 1000 - protein, 19 aa, Artificial Sequence
  synthetic
AKGPMFRGVPYNHYYGMDV

SEQ ID NO: 1001 - DNA, 324 bp, Artificial Sequence
  synthetic
gacatccagatgacccagtctccatcctccctgtctgcatctgtaggagacagagtcaccatcacttgccgggcaagtcagggcatcagaaatgatttaggctggtatcagcagaaaccagggaaagcccctaagcgcctgatctatgctgcatccagtttgcaaagtggggtctcatcaaggttcagcggcagtggatctgggacagaattcactctcacaatcagcagcctgcagcctgaagattttgcaacttattactgtctacagcataatagttacccgtacacttttggccaggggaccaaggtggaaatcaaacga

SEQ ID NO: 1002 - protein, 108 aa, Artificial Sequence
  synthetic
DIQMTQSPSSLSASVGDRVTITCRASQGIRNDLGWYQQKPGKAPKRLIYAASSLQSGVSSRFSGSGSGTEFTLTISSLQPEDFATYYCLQHNSYPYTFGQGTKVEIKR

SEQ ID NO: 1003 - DNA, 18 bp, Artificial Sequence
  synthetic
cagggcatcagaaatgat

SEQ ID NO: 1004 - protein, 6 aa, Artificial Sequence
  synthetic
QGIRND

SEQ ID NO: 1005 - DNA, 9 bp, Artificial Sequence
  synthetic
gctgcatcc

SEQ ID NO: 1006 - protein, 3 aa, Artificial Sequence
  synthetic
AAS

SEQ ID NO: 1007 - DNA, 27 bp, Artificial Sequence
  synthetic
ctacagcataatagttacccgtacact

SEQ ID NO: 1008 - protein, 9 aa, Artificial Sequence
  synthetic
LQHNSYPYT

SEQ ID NO: 1009 - DNA, 357 bp, Artificial Sequence
  synthetic
gaggtgcagctggtggagtctgggggaggcgtggtccagcctgggaggtccctgagactctcctgtacagcgtcaggtttccccttcagtcgctatggcatgcactgggtccgccaggctccaggcaaggggctggaatgggtgacatttatatggtatgatggaagtaataaatactatgcagactccgcgaagggccgattcaccatcaccagagacaattccaagaacacggtgtatctgcaaatggacagcctgagagccgatgacacggctgtttattattgtgtgagagatcaggcagctctctactattttgactcttggggccagggaaccctggtcaccgtctcctca

SEQ ID NO: 1010 - protein, 119 aa, Artificial Sequence
  synthetic
EVQLVESGGGVVQPGRSLRLSCTASGFPFSRYGMHWVRQAPGKGLEWVTFIWYDGSNKYYADSAKGRFTITRDNSKNTVYLQMDSLRADDTAVYYCVRDQAALYYFDSWGQGTLVTVSS

SEQ ID NO: 1011 - DNA, 24 bp, Artificial Sequence
  synthetic
ggtttccccttcagtcgctatggc

SEQ ID NO: 1012 - protein, 8 aa, Artificial Sequence
  synthetic
GFPFSRYG

SEQ ID NO: 1013 - DNA, 24 bp, Artificial Sequence
  synthetic
atatggtatgatggaagtaataaa

SEQ ID NO: 1014 - protein, 8 aa, Artificial Sequence
  synthetic
IWYDGSNK

SEQ ID NO: 1015 - DNA, 36 bp, Artificial Sequence
  synthetic
gtgagagatcaggcagctctctactattttgactct

SEQ ID NO: 1016 - protein, 12 aa, Artificial Sequence
  synthetic
VRDQAALYYFDS

SEQ ID NO: 1017 - DNA, 324 bp, Artificial Sequence
  synthetic
gacatccagatgacccagtctccatcttccgtgtctgcatctgtaggagacagagtcaccatcacttgtcgggcgagtcagggtattagcaggtggttagcctggtatcagcagaaaccagggaaagcccctaagctcctgatctctgctgcatccagtttgcaaagtggagtcccatcaaggttcagcggcagtggatctgggacagatttcactctcaccatcagcggcctgcagcctgaagattttgcaacttactattgtcaaaaggctaacagtttccctttcactttcggccctgggaccaagctggagatcaaacga

SEQ ID NO: 1018 - protein, 108 aa, Artificial Sequence
  synthetic
DIQMTQSPSSVSASVGDRVTITCRASQGISRWLAWYQQKPGKAPKLLISAASSLQSGVPSRFSGSGSGTDFTLTISGLQPEDFATYYCQKANSFPFTFGPGTKLEIKR

SEQ ID NO: 1019 - DNA, 18 bp, Artificial Sequence
  synthetic
cagggtattagcaggtgg

SEQ ID NO: 1020 - protein, 6 aa, Artificial Sequence
  synthetic
QGISRW

SEQ ID NO: 1021 - DNA, 9 bp, Artificial Sequence
  synthetic
gctgcatcc

SEQ ID NO: 1022 - protein, 3 aa, Artificial Sequence
  synthetic
AAS

SEQ ID NO: 1023 - DNA, 27 bp, Artificial Sequence
  synthetic
caaaaggctaacagtttccctttcact

SEQ ID NO: 1024 - protein, 9 aa, Artificial Sequence
  synthetic
QKANSFPFT

SEQ ID NO: 1025 - DNA, 378 bp, Artificial Sequence
  synthetic
gaggtgcagctggtggagtctgggggaggcgtggtccagcctgggaggtccctgagactctcctgtgcagcctctggattcaccttcagtagttatggcatgcactgggtccgccaggctccaggcaaggggctggagtgggtgacagttatattacatgatggaagtaatagatactctgcagactccgtgaagggccgattcaccatctccagagacaattccaagaacacgctttatctgcaaatgaacatcctgagagttgaggacacggctgtgtattactgtacgaaaggggctatggttcggggagtcccttacaatcactactacggcatggacgtctggggccaagggaccacggtcaccgtctcctca

SEQ ID NO: 1026 - protein, 126 aa, Artificial Sequence
  synthetic
EVQLVESGGGVVQPGRSLRLSCAASGFTFSSYGMHWVRQAPGKGLEWVTVILHDGSNRYSADSVKGRFTISRDNSKNTLYLQMNILRVEDTAVYYCTKGAMVRGVPYNHYYGMDVWGQGTTVTVSS

SEQ ID NO: 1027 - DNA, 24 bp, Artificial Sequence
  synthetic
ggattcaccttcagtagttatggc

SEQ ID NO: 1028 - protein, 8 aa, Artificial Sequence
  synthetic
GFTFSSYG

SEQ ID NO: 1029 - DNA, 24 bp, Artificial Sequence
  synthetic
atattacatgatggaagtaataga

SEQ ID NO: 1030 - protein, 8 aa, Artificial Sequence
  synthetic
ILHDGSNR

SEQ ID NO: 1031 - DNA, 57 bp, Artificial Sequence
  synthetic
acgaaaggggctatggttcggggagtcccttacaatcactactacggcatggacgtc

SEQ ID NO: 1032 - protein, 19 aa, Artificial Sequence
  synthetic
TKGAMVRGVPYNHYYGMDV

SEQ ID NO: 1033 - DNA, 324 bp, Artificial Sequence
  synthetic
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctaatctatgctgcatccattttgcaaagtggggtcccatcaaggttcagcggcagtggatctgggacagaattcactctcacaatcagcagcctgcagcctgaagattttgcaacttattactgtctacagcataatagttacccgtacacttttggccaggggaccaagctggagatcaaacga

SEQ ID NO: 1034 - protein, 108 aa, Artificial Sequence
  synthetic
DIQMTQSPSSLSASVGDRVTITCRASQGIRNDLGWYQQKPGKAPKRLIYAASILQSGVPSRFSGSGSGTEFTLTISSLQPEDFATYYCLQHNSYPYTFGQGTKLEIKR

SEQ ID NO: 1035 - DNA, 18 bp, Artificial Sequence
  synthetic
cagggcattagaaatgat

SEQ ID NO: 1036 - protein, 6 aa, Artificial Sequence
  synthetic
QGIRND

SEQ ID NO: 1037 - DNA, 9 bp, Artificial Sequence
  synthetic
gctgcatcc

SEQ ID NO: 1038 - protein, 3 aa, Artificial Sequence
  synthetic
AAS

SEQ ID NO: 1039 - DNA, 27 bp, Artificial Sequence
  synthetic
ctacagcataatagttacccgtacact

SEQ ID NO: 1040 - protein, 9 aa, Artificial Sequence
  synthetic
LQHNSYPYT

SEQ ID NO: 1041 - DNA, 378 bp, Artificial Sequence
  synthetic
gaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtgacagttatattacatgatggaagtaatagatactatgcagactccgtgaagggccgattcaccatctccagagacaattccaagaacacgctttatctgcaaatgaacatcctgagagctgaggacacggctgtgtattactgtacgaaaggggctatggttcggggagtcccttacaatcactactacggcatggacgtctggggccaagggaccacggtcaccgtctcctca

SEQ ID NO: 1042 - protein, 126 aa, Artificial Sequence
  synthetic
EVQLVESGGGVVQPGRSLRLSCAASGFTFSSYGMHWVRQAPGKGLEWVTVILHDGSNRYYADSVKGRFTISRDNSKNTLYLQMNILRAEDTAVYYCTKGAMVRGVPYNHYYGMDVWGQGTTVTVSS

SEQ ID NO: 1043 - DNA, 24 bp, Artificial Sequence
  synthetic
ggattcaccttcagtagctatggc

SEQ ID NO: 1044 - protein, 8 aa, Artificial Sequence
  synthetic
GFTFSSYG

SEQ ID NO: 1045 - DNA, 24 bp, Artificial Sequence
  synthetic
atattacatgatggaagtaataga

SEQ ID NO: 1046 - protein, 8 aa, Artificial Sequence
  synthetic
ILHDGSNR

SEQ ID NO: 1047 - DNA, 57 bp, Artificial Sequence; identical to SEQ ID NO: 1031
  synthetic

SEQ ID NO: 1048 - protein, 19 aa, Artificial Sequence
  synthetic
TKGAMVRGVPYNHYYGMDV

SEQ ID NO: 1049 - DNA, 324 bp, Artificial Sequence
  synthetic
gacatcgtgatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccaatttgcaaagtggggtcccatcaaggttcagcggcagtggatctgggacagaattcactctcacaatcagcagcctgcagcctgaagattttgcaacttattactgtctacagcataatagttacccgtacacttttggccaggggaccaagctggagatcaaacga

SEQ ID NO: 1050 - protein, 108 aa, Artificial Sequence
  synthetic
DIVMTQSPSSLSASVGDRVTITCRASQGIRNDLGWYQQKPGKAPKRLIYAASNLQSGVPSRFSGSGSGTEFTLTISSLQPEDFATYYCLQHNSYPYTFGQGTKLEIKR

SEQ ID NO: 1051 - DNA, 18 bp, Artificial Sequence
  synthetic
cagggcattagaaatgat

SEQ ID NO: 1052 - protein, 6 aa, Artificial Sequence
  synthetic
QGIRND

SEQ ID NO: 1053 - DNA, 9 bp, Artificial Sequence
  synthetic
gctgcatcc

SEQ ID NO: 1054 - protein, 3 aa, Artificial Sequence
  synthetic
AAS

SEQ ID NO: 1055 - DNA, 27 bp, Artificial Sequence
  synthetic
ctacagcataatagttacccgtacact

SEQ ID NO: 1056 - protein, 9 aa, Artificial Sequence
  synthetic
LQHNSYPYT

SEQ ID NO: 1057 - DNA, 378 bp, Artificial Sequence
  synthetic
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagactattccaagaacacgctgtatctgcaaatgaacagcctgagagctgaggacacggctgtgttttactgtgcgaaaggggctatggttcggggagtcccttacaactactactacggtatggacgtctggggccaagggaccacggtcaccgtctcctca

SEQ ID NO: 1058 - protein, 126 aa, Artificial Sequence
  synthetic
QVQLVESGGGVVQPGRSLRLSCAASGFTFSSYGMHWVRQAPGKGLEWVAVISYDGSNKYYADSVKGRFTISRDYSKNTLYLQMNSLRAEDTAVFYCAKGAMVRGVPYNYYYGMDVWGQGTTVTVSS

SEQ ID NO: 1059 - DNA, 24 bp, Artificial Sequence
  synthetic
ggattcaccttcagtagctatggc

SEQ ID NO: 1060 - protein, 8 aa, Artificial Sequence
  synthetic
GFTFSSYG

SEQ ID NO: 1061 - DNA, 24 bp, Artificial Sequence
  synthetic
atatcatatgatggaagtaataaa

SEQ ID NO: 1062 - protein, 8 aa, Artificial Sequence
  synthetic
ISYDGSNK

SEQ ID NO: 1063 - DNA, 57 bp, Artificial Sequence
  synthetic
gcgaaaggggctatggttcggggagtcccttacaactactactacggtatggacgtc

SEQ ID NO: 1064 - protein, 19 aa, Artificial Sequence
  synthetic
AKGAMVRGVPYNYYYGMDV

SEQ ID NO: 1065 - DNA, 321 bp, Artificial Sequence
  synthetic
gacatccagatgacccagtctccatcctccctgtctgcatctgtaggagacagagtcaccatcacttgccgggcaagtcagggcattagaaatgatttaggctggtttcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgtacacttttggccaggggaccaagctggagatcaaa

SEQ ID NO: 1066 - protein, 107 aa, Artificial Sequence
  synthetic
DIQMTQSPSSLSASVGDRVTITCRASQGIRNDLGWFQQKPGKAPKRLIYAASSLQSGVPSRFSGSGSGTEFTLTISSLQPEDFATYYCLQHNSYPYTFGQGTKLEIK

SEQ ID NO: 1067 - DNA, 18 bp, Artificial Sequence
  synthetic
cagggcattagaaatgat

SEQ ID NO: 1068 - protein, 6 aa, Artificial Sequence
  synthetic
QGIRND

SEQ ID NO: 1069 - DNA, 9 bp, Artificial Sequence
  synthetic
gctgcatcc

SEQ ID NO: 1070 - protein, 3 aa, Artificial Sequence
  synthetic
AAS

SEQ ID NO: 1071 - DNA, 27 bp, Artificial Sequence
  synthetic
ctacagcataatagttacccgtacact

SEQ ID NO: 1072 - protein, 9 aa, Artificial Sequence
  synthetic
LQHNSYPYT

SEQ ID NO: 1073 - DNA, 378 bp, Artificial Sequence
  synthetic
caggtgcagctggtggagtctgggggaggcgtggtccagcctgggaggtccctgagactctcctgtgcagcctctggactcaccttcagtagctatggcatgcactgggtccgccaggctccaggcaaggggctggagtgggtggcagttatatcatatgatggaagtaataaatactatacagactccgtgaagggccgattcaccatctccagagacaattctaagaacacgctgtatctgcaaatgaacagcctgagagctgaggacacggctgtgtattactgtgcgaaaggggccatggttcggggagtcccttacaactactactacggtatggacgtctggggccaagggaccacggtcaccgtctcctca

SEQ ID NO: 1074 - protein, 126 aa, Artificial Sequence
  synthetic
QVQLVESGGGVVQPGRSLRLSCAASGLTFSSYGMHWVRQAPGKGLEWVAVISYDGSNKYYTDSVKGRFTISRDNSKNTLYLQMNSLRAEDTAVYYCAKGAMVRGVPYNYYYGMDVWGQGTTVTVSS

SEQ ID NO: 1075 - DNA, 24 bp, Artificial Sequence
  synthetic
ggactcaccttcagtagctatggc

SEQ ID NO: 1076 - protein, 8 aa, Artificial Sequence
  synthetic
GLTFSSYG

SEQ ID NO: 1077 - DNA, 24 bp, Artificial Sequence
  synthetic
atatcatatgatggaagtaataaa

SEQ ID NO: 1078 - protein, 8 aa, Artificial Sequence
  synthetic
ISYDGSNK

SEQ ID NO: 1079 - DNA, 57 bp, Artificial Sequence
  synthetic
gcgaaaggggccatggttcggggagtcccttacaactactactacggtatggacgtc

SEQ ID NO: 1080 - protein, 19 aa, Artificial Sequence
  synthetic
AKGAMVRGVPYNYYYGMDV

SEQ ID NO: 1081 - DNA, 321 bp, Artificial Sequence
  synthetic
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcgtccagtttgcaaagtggggtcccatcaaggttcagcggcagtggatctgggacagaattcactctcacaatcagcagcctgcagcctgaagattttgcaacttattactgtctacagcataatagttacccgtacacttttggccaggggaccaagctggagatcaaa

SEQ ID NO: 1082 - protein, 107 aa, Artificial Sequence
  synthetic
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPYTFGQGTKLEIK

SEQ ID NO: 1083 - DNA, 18 bp, Artificial Sequence
  synthetic
cagggcattagaaatgat

SEQ ID NO: 1084 - protein, 6 aa, Artificial Sequence
  synthetic
QGIRND

SEQ ID NO: 1085 - DNA, 9 bp, Artificial Sequence
  synthetic
gctgcgtcc

SEQ ID NO: 1086 - protein, 3 aa, Artificial Sequence
  synthetic
AAS

SEQ ID NO: 1087 - DNA, 27 bp, Artificial Sequence
  synthetic
ctacagcataatagttacccgtacact

SEQ ID NO: 1088 - protein, 9 aa, Artificial Sequence
  synthetic
LQHNSYPYT

SEQ ID NO: 1089 - DNA, 378 bp, Artificial Sequence
  synthetic
caggtgcagctggtggagtctgggggaggcgtggtccagcctgggaggtccctgagactctcctgtgcagcctctggattcaccttcaggagctttggcatgcactgggtccgccaggctccaggcaaggggctggagtgggtggcagttatttcatatgatggaaattataaatactatgcagactccgtgaagggccgattcaccatctccagagacaattccaagaacacgctgtatctgcaaatgaacagcctgagagctgaggacacggctgtacattactgtgcgaaaggggctatggttcggggagtcccttacaacttctactacggtatggacgtctggggccaagggaccacggtcaccgtctcctca

SEQ ID NO: 1090 - protein, 126 aa, Artificial Sequence
  synthetic
QVQLVESGGGVVQPGRSLRLSCAASGFTFRSFGMHWVRQAPGKGLEWVAVISYDGNYKYYADSVKGRFTISRDNSKNTLYLQMNSLRAEDTAVHYCAKGAMVRGVPYNFYYGMDVWGQGTTVTVSS

SEQ ID NO: 1091 - DNA, 24 bp, Artificial Sequence
  synthetic
ggattcaccttcaggagctttggc

SEQ ID NO: 1092 - protein, 8 aa, Artificial Sequence
  synthetic
GFTFRSFG

SEQ ID NO: 1093 - DNA, 24 bp, Artificial Sequence
  synthetic
atttcatatgatggaaattataaa

SEQ ID NO: 1094 - protein, 8 aa, Artificial Sequence
  synthetic
ISYDGNYK

SEQ ID NO: 1095 - DNA, 57 bp, Artificial Sequence
  synthetic
gcgaaaggggctatggttcggggagtcccttacaacttctactacggtatggacgtc

SEQ ID NO: 1096 - protein, 19 aa, Artificial Sequence
  synthetic
AKGAMVRGVPYNFYYGMDV

SEQ ID NO: 1097 - DNA, 321 bp, Artificial Sequence
  synthetic
gacatccagatgacccagtctccatcctccctgtctgcatctgtaggagacagagtcaccatcacttgccgggcaagtcaggtcattagaaatgatttaggctggtatcagcagaaaccagggaaagcccctaagcgcctgatctatgctgcatccagtttgcaaagtgggatcccatcaaggttcagcggcagtggatctgggacagaattcactctcacaatcagcagcctgcagcctgaagattttgcaacttattactgtctacagcataatagttacccgtacacttttggccaggggaccaagctggagatcaaa

SEQ ID NO: 1098 - protein, 107 aa, Artificial Sequence
  synthetic
DIQMTQSPSSLSASVGDRVTITCRASQVIRNDLGWYQQKPGKAPKRLIYAASSLQSGIPSRFSGSGSGTEFTLTISSLQPEDFATYYCLQHNSYPYTFGQGTKLEIK

SEQ ID NO: 1099 - DNA, 18 bp, Artificial Sequence
  synthetic
caggtcattagaaatgat

SEQ ID NO: 1100 - protein, 6 aa, Artificial Sequence
  synthetic
QVIRND

SEQ ID NO: 1101 - DNA, 9 bp, Artificial Sequence
  synthetic
gctgcatcc

SEQ ID NO: 1102 - protein, 3 aa, Artificial Sequence
  synthetic
AAS

SEQ ID NO: 1103 - DNA, 27 bp, Artificial Sequence
  synthetic
ctacagcataatagttacccgtacact

SEQ ID NO: 1104 - protein, 9 aa, Artificial Sequence
  synthetic
LQHNSYPYT

SEQ ID NO: 1105 - DNA, 369 bp, Artificial Sequence
  synthetic
gaggtgcagctggtggagtctgggggaggcttggtacagcctggcaggtccctgagactctcctgtgcagcctctggattcacctttgatgattataccatgcactgggtccggcaagttccaggaaagggcctggagtggatctcaggtattagttggaatagtggtagcatggactatgcggactctgtgaagggccgattcaccatctctagagacaacgccaggaactccctgtttctgcaaatgaacagtgtgagaactgaggacacggccttgtattactgtgcaaaagataagagtggctacggctccttctactacggtatggacgtctggggccaggggaccacggtcaccgtctcctca

SEQ ID NO: 1106 - protein, 123 aa, Artificial Sequence
  synthetic
EVQLVESGGGLVQPGRSLRLSCAASGFTFDDYTMHWVRQVPGKGLEWISGISWNSGSMDYADSVKGRFTISRDNARNSLFLQMNSVRTEDTALYYCAKDKSGYGSFYYGMDVWGQGTTVTVSS

SEQ ID NO: 1107 - DNA, 24 bp, Artificial Sequence
  synthetic
ggattcacctttgatgattatacc

SEQ ID NO: 1108 - protein, 8 aa, Artificial Sequence
  synthetic
GFTFDDYT

SEQ ID NO: 1109 - DNA, 24 bp, Artificial Sequence
  synthetic
attagttggaatagtggtagcatg

SEQ ID NO: 1110 - protein, 8 aa, Artificial Sequence
  synthetic
ISWNSGSM

SEQ ID NO: 1111 - DNA, 48 bp, Artificial Sequence
  synthetic
gcaaaagataagagtggctacggctccttctactacggtatggacgtc

SEQ ID NO: 1112 - protein, 16 aa, Artificial Sequence
  synthetic
AKDKSGYGSFYYGMDV

SEQ ID NO: 1113 - DNA, 324 bp, Artificial Sequence
  synthetic
gaaattgtgttgacgcagtctccaggcaccctgtctttgtctccaggggacagagccaccctctcctgcagggccagtcagagtgtcagcagcatctacttagcctggtaccagcagaaacctggccaggctcccaggctcctcatccatggtgcgtccaccagggccactggcatcccagacaggttcagtggcagtgggtcagggacagacttcactctcaccatcagcagactggagcctgaagattttgcagtttattactgtcagcagcgtgctcactcaccgtacacttttggccaggggaccaagctggagatcaaa

SEQ ID NO: 1114 - protein, 108 aa, Artificial Sequence
  synthetic
EIVLTQSPGTLSLSPGDRATLSCRASQSVSSIYLAWYQQKPGQAPRLLIHGASTRATGIPDRFSGSGSGTDFTLTISRLEPEDFAVYYCQQRAHSPYTFGQGTKLEIK

SEQ ID NO: 1115 - DNA, 21 bp, Artificial Sequence
  synthetic
cagagtgtcagcagcatctac

SEQ ID NO: 1116 - protein, 7 aa, Artificial Sequence
  synthetic
QSVSSIY

SEQ ID NO: 1117 - DNA, 9 bp, Artificial Sequence
  synthetic
ggtgcgtcc

SEQ ID NO: 1118 - protein, 3 aa, Artificial Sequence
  synthetic
GAS

SEQ ID NO: 1119 - DNA, 27 bp, Artificial Sequence
  synthetic
cagcagcgtgctcactcaccgtacact

SEQ ID NO: 1120 - protein, 9 aa, Artificial Sequence
  synthetic
QQRAHSPYT

SEQ ID NO: 1121 - DNA, 369 bp, Artificial Sequence
  synthetic
gaagtgcagctggtggagtctgggggaggcttggtacagcctggcaggtccctgagactctcctgtgcagcctctggcttcagctttgataattatgccatgcactgggtccggcaagctccaggacagggcctggagtgggtctcaggtattagttggaatagtggtagcagagactatgcggactctgtgaagggccgattcaccatctccagagacaatgccaggaactccctgtttctgcaaatgaacagtctgagtaatgaggacacggccatgtattactgcgcaaaagataagagtggctacggctcctacttctacggtatggacgtctggggccaagggaccacggtcaccgtctcctca

SEQ ID NO: 1122 - protein, 123 aa, Artificial Sequence
  synthetic
EVQLVESGGGLVQPGRSLRLSCAASGFSFDNYAMHWVRQAPGQGLEWVSGISWNSGSRDYADSVKGRFTISRDNARNSLFLQMNSLSNEDTAMYYCAKDKSGYGSYFYGMDVWGQGTTVTVSS

SEQ ID NO: 1123 - DNA, 24 bp, Artificial Sequence
  synthetic
ggcttcagctttgataattatgcc

SEQ ID NO: 1124 - protein, 8 aa, Artificial Sequence
  synthetic
GFSFDNYA

SEQ ID NO: 1125 - DNA, 24 bp, Artificial Sequence
  synthetic
attagttggaatagtggtagcaga

SEQ ID NO: 1126 - protein, 8 aa, Artificial Sequence
  synthetic
ISWNSGSR

SEQ ID NO: 1127 - DNA, 48 bp, Artificial Sequence
  synthetic
gcaaaagataagagtggctacggctcctacttctacggtatggacgtc

SEQ ID NO: 1128 - protein, 16 aa, Artificial Sequence
  synthetic
AKDKSGYGSYFYGMDV

SEQ ID NO: 1129 - DNA, 324 bp, Artificial Sequence
  synthetic
gaaattgtgttgacgcagtctccaggcaccctgtctttgtctccaggggacagagccaccctctcctgcagggccagtcagagtattagaaacatctatttagcctggtaccagcagaaacctggccaggctcccaggctcctcatccatggtgcgtccaccagggccactggcatcccagacaggttcagtggcagtgggtcagggacagacttcactctcaccatcagcagactggagcctgaagattttgcagtttattactgtcagcagcgtgttagtttaccgtacacttttggccaggggaccaagctggagatcaaa

SEQ ID NO: 1130 - protein, 108 aa, Artificial Sequence
  synthetic
EIVLTQSPGTLSLSPGDRATLSCRASQSIRNIYLAWYQQKPGQAPRLLIHGASTRATGIPDRFSGSGSGTDFTLTISRLEPEDFAVYYCQQRVSLPYTFGQGTKLEIK

SEQ ID NO: 1131 - DNA, 21 bp, Artificial Sequence
  synthetic
cagagtattagaaacatctat

SEQ ID NO: 1132 - protein, 7 aa, Artificial Sequence
  synthetic
QSIRNIY

SEQ ID NO: 1133 - DNA, 9 bp, Artificial Sequence
  synthetic
ggtgcgtcc

SEQ ID NO: 1134 - protein, 3 aa, Artificial Sequence
  synthetic
GAS

SEQ ID NO: 1135 - DNA, 27 bp, Artificial Sequence
  synthetic
cagcagcgtgttagtttaccgtacact

SEQ ID NO: 1136 - protein, 9 aa, Artificial Sequence
  synthetic
QQRVSLPYT

SEQ ID NO: 1137 - DNA, 369 bp, Artificial Sequence
  synthetic
caggtgcagctggtggagtctgggggaggcttggtacagcctggcaggtccctgagactctcctgtgcagcctctggcttcagctttgatgattatgccatgcactgggtccggcaagctccaggacagggcctggagtgggtctcaggtattagttggaatggtggtagcagagactatgcggactctgtgaagggccgattcaccatctccagagacaacgccaggaactccctgtttctgcaaatgaacagtctgtttactgaggacacggccttgtattactgtgcaaaagataagagtggctacggctcctacttctacggtatggacgtctggggccaagggaccacggtcaccgtctcctca

SEQ ID NO: 1138 - protein, 123 aa, Artificial Sequence
  synthetic
QVQLVESGGGLVQPGRSLRLSCAASGFSFDDYAMHWVRQAPGQGLEWVSGISWNGGSRDYADSVKGRFTISRDNARNSLFLQMNSLFTEDTALYYCAKDKSGYGSYFYGMDVWGQGTTVTVSS

SEQ ID NO: 1139 - DNA, 24 bp, Artificial Sequence
  synthetic
ggcttcagctttgatgattatgcc

SEQ ID NO: 1140 - protein, 8 aa, Artificial Sequence
  synthetic
GFSFDDYA

SEQ ID NO: 1141 - DNA, 24 bp, Artificial Sequence
  synthetic
attagttggaatggtggtagcaga

SEQ ID NO: 1142 - protein, 8 aa, Artificial Sequence
  synthetic
ISWNGGSR

SEQ ID NO: 1143 - DNA, 48 bp, Artificial Sequence; identical to SEQ ID NO: 1127
  synthetic

SEQ ID NO: 1144 - protein, 16 aa, Artificial Sequence
  synthetic
AKDKSGYGSYFYGMDV

SEQ ID NO: 1145 - DNA, 324 bp, Artificial Sequence
  synthetic
gaaattgtgttgacgcagtctccaggcattctgtctttgtctccaggggacagagccaccctctcctgcagggccagtcagagtattagaaacatctatttagcctggtaccagcagaaacctggccaggctcccaggctcctcatccatggtgcgtccaccagggccactggcatcccagacaggttcagtggcagtgggtcagggacagacttcactctcaccatcagcagactggagcctgaagattttgcagtttattactgtcagcagcgtgttagttcaccgtacacttttggccaggggaccaagctggagatcaaa

SEQ ID NO: 1146 - protein, 108 aa, Artificial Sequence
  synthetic
EIVLTQSPGILSLSPGDRATLSCRASQSIRNIYLAWYQQKPGQAPRLLIHGASTRATGIPDRFSGSGSGTDFTLTISRLEPEDFAVYYCQQRVSSPYTFGQGTKLEIK

SEQ ID NO: 1147 - DNA, 21 bp, Artificial Sequence
  synthetic
cagagtattagaaacatctat

SEQ ID NO: 1148 - protein, 7 aa, Artificial Sequence
  synthetic
QSIRNIY

SEQ ID NO: 1149 - DNA, 9 bp, Artificial Sequence
  synthetic
ggtgcgtcc

SEQ ID NO: 1150 - protein, 3 aa, Artificial Sequence
  synthetic
GAS

SEQ ID NO: 1151 - DNA, 27 bp, Artificial Sequence
  synthetic
cagcagcgtgttagttcaccgtacact

SEQ ID NO: 1152 - protein, 9 aa, Artificial Sequence
  synthetic
QQRVSSPYT

SEQ ID NO: 1153 - DNA, 369 bp, Artificial Sequence
  synthetic
gaggtgcagctggtggagtctgggggaggcttggtacagcctggcaggtccctgagactctcctgtgcagcctctggattcacctttgatgattatgccatgcactgggtccggcaagctccaggaaagggcctggagtgggtctcaggtattagttggaatagtggtagcagagactatgcggactctgtgaagggccgattcaccatctccagagacaacgccaggaactccctgtttctgcaaatgaacagtctgagtactgaggacacggccttgtattactgtgcaaaagataagagtggctacggctcctactactacggtatggacgtctggggccaagggaccacggtcaccgtctcctca

SEQ ID NO: 1154 - protein, 123 aa, Artificial Sequence
  synthetic
EVQLVESGGGLVQPGRSLRLSCAASGFTFDDYAMHWVRQAPGKGLEWVSGISWNSGSRDYADSVKGRFTISRDNARNSLFLQMNSLSTEDTALYYCAKDKSGYGSYYYGMDVWGQGTTVTVSS

SEQ ID NO: 1155 - DNA, 24 bp, Artificial Sequence
  synthetic
ggattcacctttgatgattatgcc

SEQ ID NO: 1156 - protein, 8 aa, Artificial Sequence
  synthetic
GFTFDDYA

SEQ ID NO: 1157 - DNA, 24 bp, Artificial Sequence
  synthetic
attagttggaatagtggtagcaga

SEQ ID NO: 1158 - protein, 8 aa, Artificial Sequence
  synthetic
ISWNSGSR

SEQ ID NO: 1159 - DNA, 48 bp, Artificial Sequence
  synthetic
gcaaaagataagagtggctacggctcctactactacggtatggacgtc

SEQ ID NO: 1160 - protein, 16 aa, Artificial Sequence
  synthetic
AKDKSGYGSYYYGMDV

SEQ ID NO: 1161 - DNA, 324 bp, Artificial Sequence
  synthetic
gaaattgtgttgacgcagtctccaggcaccctgtctttgtctccaggggacagagccaccctctcctgcagggccagtcagagtattagaagcatctacttagcctggtaccagcagaaacctggccaggctcccaggctcctcatccatggtgcgtccaccagggccactggcatcccagacaggttcagtggcagtgggtcagggacagacttcactctcaccatcagcagactggagcctgaagattttgcagtttattactgtcagcagcgtgttagctcaccgtacacttttggccaggggaccaagctggagatcaaa

SEQ ID NO: 1162 - protein, 108 aa, Artificial Sequence
  synthetic
EIVLTQSPGTLSLSPGDRATLSCRASQSIRSIYLAWYQQKPGQAPRLLIHGASTRATGIPDRFSGSGSGTDFTLTISRLEPEDFAVYYCQQRVSSPYTFGQGTKLEIK

SEQ ID NO: 1163 - DNA, 21 bp, Artificial Sequence
  synthetic
cagagtattagaagcatctac

SEQ ID NO: 1164 - protein, 7 aa, Artificial Sequence
  synthetic
QSIRSIY

SEQ ID NO: 1165 - DNA, 9 bp, Artificial Sequence
  synthetic
ggtgcgtcc

SEQ ID NO: 1166 - protein, 3 aa, Artificial Sequence
  synthetic
GAS

SEQ ID NO: 1167 - DNA, 27 bp, Artificial Sequence
  synthetic
cagcagcgtgttagctcaccgtacact

SEQ ID NO: 1168 - protein, 9 aa, Artificial Sequence
  synthetic
QQRVSSPYT

SEQ ID NO: 1169 - DNA, 369 bp, Artificial Sequence
  synthetic
gaagtgcagctggtggagtctgggggaggcttggtacagcctggcaggtccctgagactctcctgtgtagcctctggattcacctttgctgattttaccatgcactgggtccggcaagcgccagggaagggccttgagtgggtctcaggtattagttggaatagtaatagtatagactatgcggactctgtgaagggccgattcaccatctccagagacaacgccaagaaatccctgtttctgcaaatgtccagtctgagagctgaggacacggccttatattactgtgtcaaagacagaagcggatatagcagattctactacggtatggacgtctggggccaagggaccacggtcaccgtctcctca

SEQ ID NO: 1170 - protein, 123 aa, Artificial Sequence
  synthetic
EVQLVESGGGLVQPGRSLRLSCVASGFTFADFTMHWVRQAPGKGLEWVSGISWNSNSIDYADSVKGRFTISRDNAKKSLFLQMSSLRAEDTALYYCVKDRSGYSRFYYGMDVWGQGTTVTVSS

SEQ ID NO: 1171 - DNA, 24 bp, Artificial Sequence
  synthetic
ggattcacctttgctgattttacc

SEQ ID NO: 1172 - protein, 8 aa, Artificial Sequence
  synthetic
GFTFADFT

SEQ ID NO: 1173 - DNA, 24 bp, Artificial Sequence
  synthetic
attagttggaatagtaatagtata

SEQ ID NO: 1174 - protein, 8 aa, Artificial Sequence
  synthetic
ISWNSNSI

SEQ ID NO: 1175 - DNA, 48 bp, Artificial Sequence
  synthetic
gtcaaagacagaagcggatatagcagattctactacggtatggacgtc

SEQ ID NO: 1176 - protein, 16 aa, Artificial Sequence
  synthetic
VKDRSGYSRFYYGMDV

SEQ ID NO: 1177 - DNA, 321 bp, Artificial Sequence
  synthetic
gaaattgtgatgacgcagtctccagccaccctgtctgtgtctccaggggaaagagccatcctctcctgcagggccagtcagaatattaatagcaacttggcctggtaccagcagaaacctggccaggctcccaggctcctcatctatggtgcatccaccagggccactggtgtcccagccaggttcagtggcagtgggtctgggacagagttcactctcaccatccgcagcctgcaatctgaagattttgcagtttattactgtcaacaatattataattggccgatcactttcggccacgggacacgactggagattaaa

SEQ ID NO: 1178 - protein, 107 aa, Artificial Sequence
  synthetic
EIVMTQSPATLSVSPGERAILSCRASQNINSNLAWYQQKPGQAPRLLIYGASTRATGVPARFSGSGSGTEFTLTIRSLQSEDFAVYYCQQYYNWPITFGHGTRLEIK

SEQ ID NO: 1179 - DNA, 18 bp, Artificial Sequence
  synthetic
cagaatattaatagcaac

SEQ ID NO: 1180 - protein, 6 aa, Artificial Sequence
  synthetic
QNINSN

SEQ ID NO: 1181 - DNA, 9 bp, Artificial Sequence
  synthetic
ggtgcatcc

SEQ ID NO: 1182 - protein, 3 aa, Artificial Sequence
  synthetic
GAS

SEQ ID NO: 1183 - DNA, 27 bp, Artificial Sequence
  synthetic
caacaatattataattggccgatcact

SEQ ID NO: 1184 - protein, 9 aa, Artificial Sequence
  synthetic
QQYYNWPIT

SEQ ID NO: 1185 - DNA, 369 bp, Artificial Sequence
  synthetic
gaggtgcagctggtggagtctgggggaggcttggtacagcctggcaggtccctgagactctcctgtgcagcctctggattcacctttgatgattatgccatgcactgggtccggcaagctccaggaaagggcctggagtgggtctcaggtattagttggaatggtggtagtaaagactatgcggactctgtgaagggccgattcaccatctccagagacaacaccaggaactccctgtctctgcaaatgaacagtctgagaattgaagacacggccttatattactgtgcaaaagataagagtggctacggctccttctactacggtttggacgtctggggccaagggaccacggtcaccgtctcctca

SEQ ID NO: 1186 - protein, 123 aa, Artificial Sequence
  synthetic
EVQLVESGGGLVQPGRSLRLSCAASGFTFDDYAMHWVRQAPGKGLEWVSGISWNGGSKDYADSVKGRFTISRDNTRNSLSLQMNSLRIEDTALYYCAKDKSGYGSFYYGLDVWGQGTTVTVSS

SEQ ID NO: 1187 - DNA, 24 bp, Artificial Sequence
  synthetic
ggattcacctttgatgattatgcc

SEQ ID NO: 1188 - protein, 8 aa, Artificial Sequence
  synthetic
GFTFDDYA

SEQ ID NO: 1189 - DNA, 24 bp, Artificial Sequence
  synthetic
attagttggaatggtggtagtaaa

SEQ ID NO: 1190 - protein, 8 aa, Artificial Sequence
  synthetic
ISWNGGSK

SEQ ID NO: 1191 - DNA, 48 bp, Artificial Sequence
  synthetic
gcaaaagataagagtggctacggctccttctactacggtttggacgtc

SEQ ID NO: 1192 - protein, 16 aa, Artificial Sequence
  synthetic
AKDKSGYGSFYYGLDV

SEQ ID NO: 1193 - DNA, 324 bp, Artificial Sequence
  synthetic
gaaatagtgttgacacagtctccaggcaccctgtctttgtctccaggggacagagccaccctctcctgcagggccagtcagagtattagaagcatctacttagcctggtaccagcagaaacctggccaggctcccaggctcctcatccatggtgcgtccaccagggccactggcatcccagacaggttcagtggcagtgggtcagggacagacttcactctcaccatcagcagactggagcctgaagattttgcagtttattactgtcagcagcgtgttagctcaccgtacacttttggccaggggaccaagctggagatcaaa

SEQ ID NO: 1194 - protein, 108 aa, Artificial Sequence; identical to SEQ ID NO: 1162
  synthetic

SEQ ID NO: 1195 - DNA, 21 bp, Artificial Sequence
  synthetic
cagagtattagaagcatctac

SEQ ID NO: 1196 - protein, 7 aa, Artificial Sequence
  synthetic
QSIRSIY

SEQ ID NO: 1197 - DNA, 9 bp, Artificial Sequence
  synthetic
ggtgcgtcc

SEQ ID NO: 1198 - protein, 3 aa, Artificial Sequence
  synthetic
GAS

SEQ ID NO: 1199 - DNA, 27 bp, Artificial Sequence
  synthetic
cagcagcgtgttagctcaccgtacact

SEQ ID NO: 1200 - protein, 9 aa, Artificial Sequence
  synthetic
QQRVSSPYT

SEQ ID NO: 1201 - DNA, 369 bp, Artificial Sequence
  synthetic
gaggtgcagctggtggagtctgggggaggcttggtacagcctggcaggtccctgagactctcctgtgcagcctctggattcacctttgatgatttcaccatgcactgggtccggcaagctccaggaaagggcctggagtgggtctcagatattagttggaatagtggtagcatagactatgcggactctgtgaagggccgattcaccatttccagagacaatgccaggaactccctgtttctacaaatgagcagtctgagaactgaggacacggcctcgtattactgtataaaagataagagtggctacggctcctacaactacggtctggacgtctggggccaagggaccacggtcaccgtctcctca

SEQ ID NO: 1202 - protein, 123 aa, Artificial Sequence
  synthetic
EVQLVESGGGLVQPGRSLRLSCAASGFTFDDFTMHWVRQAPGKGLEWVSDISWNSGSIDYADSVKGRFTISRDNARNSLFLQMSSLRTEDTASYYCIKDKSGYGSYNYGLDVWGQGTTVTVSS

SEQ ID NO: 1203 - DNA, 24 bp, Artificial Sequence
  synthetic
ggattcacctttgatgatttcacc

SEQ ID NO: 1204 - protein, 8 aa, Artificial Sequence
  synthetic
GFTFDDFT

SEQ ID NO: 1205 - DNA, 24 bp, Artificial Sequence
  synthetic
attagttggaatagtggtagcata

SEQ ID NO: 1206 - protein, 8 aa, Artificial Sequence
  synthetic
ISWNSGSI

SEQ ID NO: 1207 - DNA, 48 bp, Artificial Sequence
  synthetic
ataaaagataagagtggctacggctcctacaactacggtctggacgtc

SEQ ID NO: 1208 - protein, 16 aa, Artificial Sequence
  synthetic
IKDKSGYGSYNYGLDV

SEQ ID NO: 1209 - DNA, 324 bp, Artificial Sequence
  synthetic
gaaattgtgttgacgcagtctccaggcaccctgtctttgtctccaggggacagagccaccctctcctgcagggccagtcagagtgttagcagcatctacttagcctggtaccagcagaaacctggccaggctcccaggctcctcatccatggtgcgtccaccagggccactggcatcccagacaggttcagtggcagtgggtcggggacagacttcactctcaccatcagcagactggagcctgaagattttgcactttattactgtcaccagcgtgttagttcaccgtacacttttggccaggggaccaagctggagatcaaa

SEQ ID NO: 1210 - protein, 108 aa, Artificial Sequence
  synthetic
EIVLTQSPGTLSLSPGDRATLSCRASQSVSSIYLAWYQQKPGQAPRLLIHGASTRATGIPDRFSGSGSGTDFTLTISRLEPEDFALYYCHQRVSSPYTFGQGTKLEIK

SEQ ID NO: 1211 - DNA, 21 bp, Artificial Sequence
  synthetic
cagagtgttagcagcatctac

SEQ ID NO: 1212 - protein, 7 aa, Artificial Sequence
  synthetic
QSVSSIY

SEQ ID NO: 1213 - DNA, 9 bp, Artificial Sequence
  synthetic
ggtgcgtcc

SEQ ID NO: 1214 - protein, 3 aa, Artificial Sequence
  synthetic
GAS

SEQ ID NO: 1215 - DNA, 27 bp, Artificial Sequence
  synthetic
caccagcgtgttagttcaccgtacact

SEQ ID NO: 1216 - protein, 9 aa, Artificial Sequence
  synthetic
HQRVSSPYT

SEQ ID NO: 1217 - DNA, 369 bp, Artificial Sequence
  synthetic
gaggtgcagctggtggagtctgggggaggcttggtacagcctggcaggtccctgagactctcctgtgcagcctctggattcacctttgatgattatgccatgcactgggtccggcaagctccaggaaagggcctggagtgggtctcaggtattagttggaatagtggtagtaaagactatgcggactctgtgaagggccgattcaccatctccagagacaacaccaggaactccctgtttctgcaaatgaacagtctgagaactgaagacacggccttatattactgtgcaaaagataagagtggctacggctccttctactacggtatggacgtctggggccaagggaccacggtcaccgtctcctca

SEQ ID NO: 1218 - protein, 123 aa, Artificial Sequence
  synthetic
EVQLVESGGGLVQPGRSLRLSCAASGFTFDDYAMHWVRQAPGKGLEWVSGISWNSGSKDYADSVKGRFTISRDNTRNSLFLQMNSLRTEDTALYYCAKDKSGYGSFYYGMDVWGQGTTVTVSS

SEQ ID NO: 1219 - DNA, 24 bp, Artificial Sequence
  synthetic
ggattcacctttgatgattatgcc

SEQ ID NO: 1220 - protein, 8 aa, Artificial Sequence
  synthetic
GFTFDDYA

SEQ ID NO: 1221 - DNA, 24 bp, Artificial Sequence
  synthetic
attagttggaatagtggtagtaaa

SEQ ID NO: 1222 - protein, 8 aa, Artificial Sequence
  synthetic
ISWNSGSK

SEQ ID NO: 1223 - DNA, 48 bp, Artificial Sequence; identical to SEQ ID NO: 1111
  synthetic

SEQ ID NO: 1224 - protein, 16 aa, Artificial Sequence
  synthetic
AKDKSGYGSFYYGMDV

SEQ ID NO: 1225 - DNA, 318 bp, Artificial Sequence
  synthetic
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattctccgttcggccaagggaccaaggtggaaatcaaa

SEQ ID NO: 1226 - protein, 106 aa, Artificial Sequence
  synthetic
DIQMTQSPSTLSASVGDRVTITCRASQSISSWLAWYQQKPGKAPKLLIYKASSLESGVPSRFSGSGSGTEFTLTISSLQPDDFATYYCQQYNSYSPFGQGTKVEIK

SEQ ID NO: 1227 - DNA, 18 bp, Artificial Sequence
  synthetic
cagagtattagtagctgg

SEQ ID NO: 1228 - protein, 6 aa, Artificial Sequence
  synthetic
QSISSW

SEQ ID NO: 1229 - DNA, 9 bp, Artificial Sequence
  synthetic
aaggcgtct

SEQ ID NO: 1230 - protein, 3 aa, Artificial Sequence
  synthetic
KAS

SEQ ID NO: 1231 - DNA, 24 bp, Artificial Sequence
  synthetic
caacagtataatagttattctccg

SEQ ID NO: 1232 - protein, 8 aa, Artificial Sequence
  synthetic
QQYNSYSP

SEQ ID NO: 1233 - DNA, 372 bp, Artificial Sequence
  synthetic
caggtgcaactggtggagtctgggggaggcgtggtccagcctgggaggtccctgagactctcctgtgcagcctctggactcaccttcagtacctatgtcatgcactgggtccgccaggctccaggcaaggggctggcgtgggtggcagttatagcaaatgatggaagtaataaatattatgcagactccgtgaagggccgattcaccatctccagagacaactccaagaacacgctgtatctgcaaatgaatagcctgagacctgaggacacggctgtgtatttttgtgcgaaagaggggggtaccagtgggtcctactattactatggaatggacgtctggggtcaagggactacggtcaccgtctcctca

SEQ ID NO: 1234 - protein, 124 aa, Artificial Sequence
  synthetic
QVQLVESGGGVVQPGRSLRLSCAASGLTFSTYVMHWVRQAPGKGLAWVAVIANDGSNKYYADSVKGRFTISRDNSKNTLYLQMNSLRPEDTAVYFCAKEGGTSGSYYYYGMDVWGQGTTVTVSS

SEQ ID NO: 1235 - DNA, 24 bp, Artificial Sequence
  synthetic
ggactcaccttcagtacctatgtc

SEQ ID NO: 1236 - protein, 8 aa, Artificial Sequence
  synthetic
GLTFSTYV

SEQ ID NO: 1237 - DNA, 24 bp, Artificial Sequence
  synthetic
atagcaaatgatggaagtaataaa

SEQ ID NO: 1238 - protein, 8 aa, Artificial Sequence
  synthetic
IANDGSNK

SEQ ID NO: 1239 - DNA, 51 bp, Artificial Sequence
  synthetic
gcgaaagaggggggtaccagtgggtcctactattactatggaatggacgtc

SEQ ID NO: 1240 - protein, 17 aa, Artificial Sequence
  synthetic
AKEGGTSGSYYYYGMDV

SEQ ID NO: 1241 - DNA, 342 bp, Artificial Sequence
  synthetic
gacatccagatgacccagtctccagactccctggctgtgtctctgggcgagagggccaccatcaactgcaagtccagccagagtcttttattcaactccatcaataagaactacttagcttggtaccagcagaaaccaggacagcctcctaagcttctcctttactgggcatctacccgggaatccgggatccctgaccgattcagtggcagcgggtctgggacagatttcactctcaccatcaccagcctgcaggctgaagatgtggcactttattactgtcagcaatattatagtattccgtggacgttcggccaagggaccaaggtggaaatcaaacga

SEQ ID NO: 1242 - protein, 114 aa, Artificial Sequence
  synthetic
DIQMTQSPDSLAVSLGERATINCKSSQSLLFNSINKNYLAWYQQKPGQPPKLLLYWASTRESGIPDRFSGSGSGTDFTLTITSLQAEDVALYYCQQYYSIPWTFGQGTKVEIKR

SEQ ID NO: 1243 - DNA, 36 bp, Artificial Sequence
  synthetic
cagagtcttttattcaactccatcaataagaactac

SEQ ID NO: 1244 - protein, 12 aa, Artificial Sequence
  synthetic
QSLLFNSINKNY

SEQ ID NO: 1245 - DNA, 9 bp, Artificial Sequence
  synthetic
tgggcatct

SEQ ID NO: 1246 - protein, 3 aa, Artificial Sequence
  synthetic
WAS

SEQ ID NO: 1247 - DNA, 27 bp, Artificial Sequence
  synthetic
cagcaatattatagtattccgtggacg

SEQ ID NO: 1248 - protein, 9 aa, Artificial Sequence
  synthetic
QQYYSIPWT

SEQ ID NO: 1249 - DNA, 354 bp, Artificial Sequence
  synthetic
caggtgcagctggtggagtctggggctgaagtgaagaagcctggggcctcagtgaaggtctcctgcaagacttctggatacaccttcaccggctactatatgcactggatacgacaggcccctggacaagggcttgagtggatgggatggatcaaccctaaaagtggtggcacaaattatgcacagaagtttcagggcagggtcaccatgaccagggacacgtccatcagcacagcctacatggaactgagcaggctgagatccgacgacatggccgtgtattattgtgcgagaatgggggacggtgcagtgtttgacttctggggccagggaaccctggtcaccgtctcctca

SEQ ID NO: 1250 - protein, 118 aa, Artificial Sequence
  synthetic
QVQLVESGAEVKKPGASVKVSCKTSGYTFTGYYMHWIRQAPGQGLEWMGWINPKSGGTNYAQKFQGRVTMTRDTSISTAYMELSRLRSDDMAVYYCARMGDGAVFDFWGQGTLVTVSS

SEQ ID NO: 1251 - DNA, 24 bp, Artificial Sequence
  synthetic
ggatacaccttcaccggctactat

SEQ ID NO: 1252 - protein, 8 aa, Artificial Sequence
  synthetic
GYTFTGYY

SEQ ID NO: 1253 - DNA, 24 bp, Artificial Sequence
  synthetic
atcaaccctaaaagtggtggcaca

SEQ ID NO: 1254 - protein, 8 aa, Artificial Sequence
  synthetic
INPKSGGT

SEQ ID NO: 1255 - DNA, 33 bp, Artificial Sequence
  synthetic
gcgagaatgggggacggtgcagtgtttgacttc

SEQ ID NO: 1256 - protein, 11 aa, Artificial Sequence
  synthetic
ARMGDGAVFDF

SEQ ID NO: 1257 - DNA, 324 bp, Artificial Sequence
  synthetic
gccatccagatgacccagtctccatcctccctgtctgcatctgtaggagacagagtcaccatcacttgccgggcaagtcagaggattagcagctttttaaattggtatcagcagaaaccagggaaagcccctaagctcctgatctatactgcatccaatttacaaaatggggtcccatcaaggttcagtggcagtggatctgggacagatttcactctcactatcagcagtctgcaacctgaagattttgctacttactactgtcaacagagttacaggaccccgctcactttcggcggagggaccaaggtggaaatcaaacga

SEQ ID NO: 1258 - protein, 108 aa, Artificial Sequence
  synthetic
AIQMTQSPSSLSASVGDRVTITCRASQRISSFLNWYQQKPGKAPKLLIYTASNLQNGVPSRFSGSGSGTDFTLTISSLQPEDFATYYCQQSYRTPLTFGGGTKVEIKR

SEQ ID NO: 1259 - DNA, 18 bp, Artificial Sequence
  synthetic
cagaggattagcagcttt

SEQ ID NO: 1260 - protein, 6 aa, Artificial Sequence
  synthetic
QRISSF

SEQ ID NO: 1261 - DNA, 9 bp, Artificial Sequence
  synthetic
actgcatcc

SEQ ID NO: 1262 - protein, 3 aa, Artificial Sequence
  synthetic
TAS

SEQ ID NO: 1263 - DNA, 27 bp, Artificial Sequence
  synthetic
caacagagttacaggaccccgctcact

SEQ ID NO: 1264 - protein, 9 aa, Artificial Sequence
  synthetic
QQSYRTPLT

SEQ ID NO: 1265 - DNA, 369 bp, Artificial Sequence
  synthetic
gaggtgcagctggtggagtctgggggaggcttggtacagcctggcaggtccctgagactctcctgtgcagcctctggattcacctttgatgattataccatgcactgggtccggcaagctccagggaagggcctggagtgggtctcaggtattagttggaacagtggtagcataggctatgcggactctgtgaagggccgattcaccatttccagagacaacgccaagaactccctgtatttgcaaatgaacagtctgagagctgaggacacggccttgttttactgtgcaaaagatcaaagtggttacggccactactactacggtatggacgtctggggccaagggaccacggtcaccgtctcctca

SEQ ID NO: 1266 - protein, 123 aa, Artificial Sequence
  synthetic
EVQLVESGGGLVQPGRSLRLSCAASGFTFDDYTMHWVRQAPGKGLEWVSGISWNSGSIGYADSVKGRFTISRDNAKNSLYLQMNSLRAEDTALFYCAKDQSGYGHYYYGMDVWGQGTTVTVSS

SEQ ID NO: 1267 - DNA, 24 bp, Artificial Sequence
  synthetic
ggattcacctttgatgattatacc

SEQ ID NO: 1268 - protein, 8 aa, Artificial Sequence
  synthetic
GFTFDDYT

SEQ ID NO: 1269 - DNA, 24 bp, Artificial Sequence
  synthetic
attagttggaacagtggtagcata

SEQ ID NO: 1270 - protein, 8 aa, Artificial Sequence
  synthetic
ISWNSGSI

SEQ ID NO: 1271 - DNA, 48 bp, Artificial Sequence
  synthetic
gcaaaagatcaaagtggttacggccactactactacggtatggacgtc

SEQ ID NO: 1272 - protein, 16 aa, Artificial Sequence
  synthetic
AKDQSGYGHYYYGMDV

SEQ ID NO: 1273 - DNA, 321 bp, Artificial Sequence
  synthetic
gaaatagtgatgacgcagtctccagccaccctgtctgtgtctccaggggaaagagccaccctctcctgtagggccagtcagagtgttagcagcaacttagcctggtaccagcagaaacctggccaggctcccaggctcctcatctatggtgcatccaccagggccactgatatcccagccaggttcagtggcagtgggtctgggacagagttcactctcaccatcagcagcctgcagtctgaagattttgcagtttatcactgtcagcagtataataactggccgctcactttcggcggagggaccaaggtggagatcaaa

SEQ ID NO: 1274 - protein, 107 aa, Artificial Sequence
  synthetic
EIVMTQSPATLSVSPGERATLSCRASQSVSSNLAWYQQKPGQAPRLLIYGASTRATDIPARFSGSGSGTEFTLTISSLQSEDFAVYHCQQYNNWPLTFGGGTKVEIK

SEQ ID NO: 1275 - DNA, 18 bp, Artificial Sequence
  synthetic
cagagtgttagcagcaac

SEQ ID NO: 1276 - protein, 6 aa, Artificial Sequence
  synthetic
QSVSSN

SEQ ID NO: 1277 - DNA, 9 bp, Artificial Sequence
  synthetic
ggtgcatcc

SEQ ID NO: 1278 - protein, 3 aa, Artificial Sequence
  synthetic
GAS

SEQ ID NO: 1279 - DNA, 27 bp, Artificial Sequence
  synthetic
cagcagtataataactggccgctcact

SEQ ID NO: 1280 - protein, 9 aa, Artificial Sequence
  synthetic
QQYNNWPLT

SEQ ID NO: 1281 - DNA, 387 bp, Artificial Sequence
  synthetic
gaggtgcagctggtggagtctgggggaggcgtggtccagcctgggaggtccctgagactctcctgtgcagcctctggattcaccttcagttactatggcatgcactgggtccgccaggctccaggcaaggggctggagtgggtggcagttatatcatttgatggaaagaataaatattatgcagactccgtgatgggccgattcaccatctccagagacaattccaagaatacactgtatctgcaaatgaacagcctgagagctgaggactcggctgtgtttttctgtgcgaggtcttacgacattttgactggttatggagccggttacagctaccactacggtatggacgtctggggccaagggaccacggtcaccgtctcctca

SEQ ID NO: 1282 - protein, 129 aa, Artificial Sequence
  synthetic
EVQLVESGGGVVQPGRSLRLSCAASGFTFSYYGMHWVRQAPGKGLEWVAVISFDGKNKYYADSVMGRFTISRDNSKNTLYLQMNSLRAEDSAVFFCARSYDILTGYGAGYSYHYGMDVWGQGTTVTVSS

SEQ ID NO: 1283 - DNA, 24 bp, Artificial Sequence
  synthetic
ggattcaccttcagttactatggc

SEQ ID NO: 1284 - protein, 8 aa, Artificial Sequence
  synthetic
GFTFSYYG

SEQ ID NO: 1285 - DNA, 24 bp, Artificial Sequence
  synthetic
atatcatttgatggaaagaataaa

SEQ ID NO: 1286 - protein, 8 aa, Artificial Sequence
  synthetic
ISFDGKNK

SEQ ID NO: 1287 - DNA, 66 bp, Artificial Sequence
  synthetic
gcgaggtcttacgacattttgactggttatggagccggttacagctaccactacggtatggacgtc

SEQ ID NO: 1288 - protein, 22 aa, Artificial Sequence
  synthetic
ARSYDILTGYGAGYSYHYGMDV

SEQ ID NO: 1289 - DNA, 324 bp, Artificial Sequence
  synthetic
gccatccagatgacccagtctccatcctccctgtctgcatctgtaggagacagagtcaccatcacttgccgggcaagtcagaggattagcagctttttaaattggtatcagcagaaaccagggaaagcccctaagctcctaatctatactgcatccaatttacaaaatggggtcccatcaaggttcagtggcagtggatctgggacagatttcactctcaccatcagcagtctgcaacctgaagattttgcaacttactactgtcaacagagttacaggaccccgctcactttcggcggagggaccaaggtggagatcaaacga

SEQ ID NO: 1290 - protein, 108 aa, Artificial Sequence; identical to SEQ ID NO: 1258
  synthetic

SEQ ID NO: 1291 - DNA, 18 bp, Artificial Sequence
  synthetic
cagaggattagcagcttt

SEQ ID NO: 1292 - protein, 6 aa, Artificial Sequence
  synthetic
QRISSF

SEQ ID NO: 1293 - DNA, 9 bp, Artificial Sequence
  synthetic
actgcatcc

SEQ ID NO: 1294 - protein, 3 aa, Artificial Sequence
  synthetic
TAS

SEQ ID NO: 1295 - DNA, 27 bp, Artificial Sequence
  synthetic
caacagagttacaggaccccgctcact

SEQ ID NO: 1296 - protein, 9 aa, Artificial Sequence
  synthetic
QQSYRTPLT

SEQ ID NO: 1297 - DNA, 354 bp, Artificial Sequence
  synthetic
caggtgcagctggtggagtctggggctgaagtgaagaagcctggggcctcagtgaaggtctcctgcaagacttctggatacaccctctccggctattatatgcactggatgcgacaggcccctggacaagggcttgagtggatgggatggattaaccctaaaagtggtgtcacaaattatgcacagaagtttcaggacagagtcgccatgaccagggacacgtccatcagcacagcctacatggaactgagcaggctgagatctgacgacacggccgtgtattactgtgcgagaatgggggacggtgcagtgtttgacttctgggcccagggaaccctggtcaccgtctcctca

SEQ ID NO: 1298 - protein, 118 aa, Artificial Sequence
  synthetic
QVQLVESGAEVKKPGASVKVSCKTSGYTLSGYYMHWMRQAPGQGLEWMGWINPKSGVTNYAQKFQDRVAMTRDTSISTAYMELSRLRSDDTAVYYCARMGDGAVFDFWAQGTLVTVSS

SEQ ID NO: 1299 - DNA, 24 bp, Artificial Sequence
  synthetic
ggatacaccctctccggctattat

SEQ ID NO: 1300 - protein, 8 aa, Artificial Sequence
  synthetic
GYTLSGYY

SEQ ID NO: 1301 - DNA, 24 bp, Artificial Sequence
  synthetic
attaaccctaaaagtggtgtcaca

SEQ ID NO: 1302 - protein, 8 aa, Artificial Sequence
  synthetic
INPKSGVT

SEQ ID NO: 1303 - DNA, 33 bp, Artificial Sequence; identical to SEQ ID NO: 1255
  synthetic

SEQ ID NO: 1304 - protein, 11 aa, Artificial Sequence
  synthetic
ARMGDGAVFDF

SEQ ID NO: 1305 - DNA, 324 bp, Artificial Sequence
  synthetic
gacatccagttgacccagtctccatcctccctgtctgcatctgtaggagacagagtcaccatcacttgccgggcaagtcagaggattagcagctttttaaattggtatcagcagaaaccagggaaagcccctaagctcctaatctatactgcatccaatttacaaaatggggtcccatcaaggttcagtggcagtggatctgggacagatttcactctcaccatcagcagtctgcaacctgaagattttgcaacttactactgtcaacagagttacaggaccccgctcactttcggcggagggaccaagctggagatcaaacga

SEQ ID NO: 1306 - protein, 108 aa, Artificial Sequence
  synthetic
DIQLTQSPSSLSASVGDRVTITCRASQRISSFLNWYQQKPGKAPKLLIYTASNLQNGVPSRFSGSGSGTDFTLTISSLQPEDFATYYCQQSYRTPLTFGGGTKLEIKR

SEQ ID NO: 1307 - DNA, 18 bp, Artificial Sequence
  synthetic
cagaggattagcagcttt

SEQ ID NO: 1308 - protein, 6 aa, Artificial Sequence
  synthetic
QRISSF

SEQ ID NO: 1309 - DNA, 9 bp, Artificial Sequence
  synthetic
actgcatcc

SEQ ID NO: 1310 - protein, 3 aa, Artificial Sequence
  synthetic
TAS

SEQ ID NO: 1311 - DNA, 27 bp, Artificial Sequence
  synthetic
caacagagttacaggaccccgctcact

SEQ ID NO: 1312 - protein, 9 aa, Artificial Sequence
  synthetic
QQSYRTPLT

SEQ ID NO: 1313 - DNA, 372 bp, Artificial Sequence
  synthetic
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtgtcaactatatcatttgatggaagtaacaaatactatgcagactccgtgaagggccgattcaccatctccagagacaattccaagaacacgctgtatctgcaaatgaacagcctgagacctgaggacacggctgtgtattactgtgcgaaaggggggggtaccagtgggtcctacttttactacggtatggacgtctggggccaagggaccacggtcaccgtctcctca

SEQ ID NO: 1314 - protein, 124 aa, Artificial Sequence
  synthetic
QVQLVESGGGVVQPGRSLRLSCAASGFTFSSYGMHWVRQAPGKGLEWVSTISFDGSNKYYADSVKGRFTISRDNSKNTLYLQMNSLRPEDTAVYYCAKGGGTSGSYFYYGMDVWGQGTTVTVSS

SEQ ID NO: 1315 - DNA, 24 bp, Artificial Sequence
  synthetic
ggattcaccttcagtagctatggc

SEQ ID NO: 1316 - protein, 8 aa, Artificial Sequence
  synthetic
GFTFSSYG

SEQ ID NO: 1317 - DNA, 24 bp, Artificial Sequence
  synthetic
atatcatttgatggaagtaacaaa

SEQ ID NO: 1318 - protein, 8 aa, Artificial Sequence
  synthetic
ISFDGSNK

SEQ ID NO: 1319 - DNA, 51 bp, Artificial Sequence
  synthetic
gcgaaaggggggggtaccagtgggtcctacttttactacggtatggacgtc

SEQ ID NO: 1320 - protein, 17 aa, Artificial Sequence
  synthetic
AKGGGTSGSYFYYGMDV

SEQ ID NO: 1321 - DNA, 324 bp, Artificial Sequence
  synthetic
gccatccagatgacccagtctccatcctccctgtctgcatctgtaggagacagagtcaccatcacttgccgggcaagtcagaggattagcagctttttaaattggtatcagcagaaaccagggaaagcccctaagctcctaatctatactgcatccaatttacaaaatggggtcccatcaaggttcagtggcagtggatctgggacagatttcactctcaccatcagcagtctgcaacctgaagattttgcaacttactactgtcaacagagttacaggaccccgctcactttcggcggagggaccaagctggagatcaaacga

SEQ ID NO: 1322 - protein, 108 aa, Artificial Sequence
  synthetic
AIQMTQSPSSLSASVGDRVTITCRASQRISSFLNWYQQKPGKAPKLLIYTASNLQNGVPSRFSGSGSGTDFTLTISSLQPEDFATYYCQQSYRTPLTFGGGTKLEIKR

SEQ ID NO: 1323 - DNA, 18 bp, Artificial Sequence
  synthetic
cagaggattagcagcttt

SEQ ID NO: 1324 - protein, 6 aa, Artificial Sequence
  synthetic
QRISSF

SEQ ID NO: 1325 - DNA, 9 bp, Artificial Sequence
  synthetic
actgcatcc

SEQ ID NO: 1326 - protein, 3 aa, Artificial Sequence
  synthetic
TAS

SEQ ID NO: 1327 - DNA, 27 bp, Artificial Sequence
  synthetic
caacagagttacaggaccccgctcact

SEQ ID NO: 1328 - protein, 9 aa, Artificial Sequence
  synthetic
QQSYRTPLT

SEQ ID NO: 1329 - DNA, 354 bp, Artificial Sequence
  synthetic
caggttcagctggtgcagtctgggactgaggtgaagaagcctggggcctcaatgaaggtctcctgcaaggcttctggatacaccttcaccggctactatattcactgggtgcgacaggcccctggacaagggcttgagtggatgggatggatcaaccctaacagtgatgtcacaaagtatgcacagaagtttcagggcagggtcaccttgaccagggacacgtccatcagtgcagcctatattgacctgagcaggctgagatctgacgacacggccatttattactgtgcgagaatgggggacggtgcagtgtttgactactggggccagggaaccctggtcaccgtctcctca

SEQ ID NO: 1330 - protein, 118 aa, Artificial Sequence
  synthetic
QVQLVQSGTEVKKPGASMKVSCKASGYTFTGYYIHWVRQAPGQGLEWMGWINPNSDVTKYAQKFQGRVTLTRDTSISAAYIDLSRLRSDDTAIYYCARMGDGAVFDYWGQGTLVTVSS

SEQ ID NO: 1331 - DNA, 24 bp, Artificial Sequence
  synthetic
ggatacaccttcaccggctactat

SEQ ID NO: 1332 - protein, 8 aa, Artificial Sequence
  synthetic
GYTFTGYY

SEQ ID NO: 1333 - DNA, 24 bp, Artificial Sequence
  synthetic
atcaaccctaacagtgatgtcaca

SEQ ID NO: 1334 - protein, 8 aa, Artificial Sequence
  synthetic
INPNSDVT

SEQ ID NO: 1335 - DNA, 33 bp, Artificial Sequence
  synthetic
gcgagaatgggggacggtgcagtgtttgactac

SEQ ID NO: 1336 - protein, 11 aa, Artificial Sequence
  synthetic
ARMGDGAVFDY

SEQ ID NO: 1337 - DNA, 324 bp, Artificial Sequence
  synthetic
gacatccagttgacccagtctccatcctccctgtctgcatctgtaggagacagagtcaccatcacttgccgggcaagtcaacgcattagcagctatttaaattggtatcaacagaaaccagggaaagcccctaaggtgctgatctctgttgcatccagtttacaaagtggggtcccatcaaggttcagtggcagtggatttgggacagatttcactctcaccatcagcagtctgcaacctgaggattctgcatcttactactgtcaacagagttacaataccccgctcactttcggcggcgggaccaagctggagatcaaacga

SEQ ID NO: 1338 - protein, 108 aa, Artificial Sequence
  synthetic
DIQLTQSPSSLSASVGDRVTITCRASQRISSYLNWYQQKPGKAPKVLISVASSLQSGVPSRFSGSGFGTDFTLTISSLQPEDSASYYCQQSYNTPLTFGGGTKLEIKR

SEQ ID NO: 1339 - DNA, 18 bp, Artificial Sequence
  synthetic
caacgcattagcagctat

SEQ ID NO: 1340 - protein, 6 aa, Artificial Sequence
  synthetic
QRISSY

SEQ ID NO: 1341 - DNA, 9 bp, Artificial Sequence
  synthetic
gttgcatcc

SEQ ID NO: 1342 - protein, 3 aa, Artificial Sequence
  synthetic
VAS

SEQ ID NO: 1343 - DNA, 27 bp, Artificial Sequence
  synthetic
caacagagttacaataccccgctcact

SEQ ID NO: 1344 - protein, 9 aa, Artificial Sequence
  synthetic
QQSYNTPLT

SEQ ID NO: 1345 - DNA, 354 bp, Artificial Sequence
  synthetic
gaggtgcagctggtggagtctggggctgaagtgaagaagcctggggcctcagtgaaggtctcctgcaagacttctggatacagtttcattggctattatatacactggatgcgacaggcccctggacaagggcttgaatggatgggatggatcaaccctaagagtggtgtcacaaattatgcacagaggtttcagggcagggtcaccatgaccagggacacgtccatcagtactgcctacatggaactgagcaggctgaaatctgacgacacggccgtgtatttctgtgcgagaatgggggacggtgcagtgtttgacttctggggccagggaaccctggtcaccgtctcctca

SEQ ID NO: 1346 - protein, 118 aa, Artificial Sequence
  synthetic
EVQLVESGAEVKKPGASVKVSCKTSGYSFIGYYIHWMRQAPGQGLEWMGWINPKSGVTNYAQRFQGRVTMTRDTSISTAYMELSRLKSDDTAVYFCARMGDGAVFDFWGQGTLVTVSS

SEQ ID NO: 1347 - DNA, 24 bp, Artificial Sequence
  synthetic
ggatacagtttcattggctattat

SEQ ID NO: 1348 - protein, 8 aa, Artificial Sequence
  synthetic
GYSFIGYY

SEQ ID NO: 1349 - DNA, 24 bp, Artificial Sequence
  synthetic
atcaaccctaagagtggtgtcaca

SEQ ID NO: 1350 - protein, 8 aa, Artificial Sequence
  synthetic
INPKSGVT

SEQ ID NO: 1351 - DNA, 33 bp, Artificial Sequence; identical to SEQ ID NO: 1255
  synthetic

SEQ ID NO: 1352 - protein, 11 aa, Artificial Sequence
  synthetic
ARMGDGAVFDF

SEQ ID NO: 1353 - DNA, 324 bp, Artificial Sequence
  synthetic
gacatccagttgacccagtctccatcctccctgtctgcatctgtaggagacagagtcaccatcacttgccgggcaagtcagaggattagcagctttttaaattggtatcagcagaaaccagggaaagtccctaagctcctgatctatactgcatccaatttacaaaatggggtcccatcaaggttcagtggcactggatctgggacagatttcactctcaccatcagcagtctgcaacctgaagattttgcaacttactactgtcaacagagttacaggaccccgctcactttcggcggagggaccaaagtggatatcaaacga

SEQ ID NO: 1354 - protein, 108 aa, Artificial Sequence
  synthetic
DIQLTQSPSSLSASVGDRVTITCRASQRISSFLNWYQQKPGKVPKLLIYTASNLQNGVPSRFSGTGSGTDFTLTISSLQPEDFATYYCQQSYRTPLTFGGGTKVDIKR

SEQ ID NO: 1355 - DNA, 18 bp, Artificial Sequence
  synthetic
cagaggattagcagcttt

SEQ ID NO: 1356 - protein, 6 aa, Artificial Sequence
  synthetic
QRISSF

SEQ ID NO: 1357 - DNA, 9 bp, Artificial Sequence
  synthetic
actgcatcc

SEQ ID NO: 1358 - protein, 3 aa, Artificial Sequence
  synthetic
TAS

SEQ ID NO: 1359 - DNA, 27 bp, Artificial Sequence
  synthetic
caacagagttacaggaccccgctcact

SEQ ID NO: 1360 - protein, 9 aa, Artificial Sequence
  synthetic
QQSYRTPLT

SEQ ID NO: 1361 - DNA, 354 bp, Artificial Sequence
  synthetic
gaggtgcagctggtggagtctggggctgaagtgaagaagcctggggcctcagtgaaggtctcctgcaagacttctggatacaccttcaccggctactatatgcactggatacgacaggcccctggacaagggcttgagtggatgggatggatcaaccctaaaagtggtggcacaaattatgcacagaagtttcagggcagggtcaccatgaccagggacacgtccatcagcacagcctacatggaactgagcaggctgagatccgacgacatggccgtgtattattgtgcgagaatgggggacggtgcagtgtttgacttctggggccagggaaccctggtcaccgtctcctca

SEQ ID NO: 1362 - protein, 118 aa, Artificial Sequence
  synthetic
EVQLVESGAEVKKPGASVKVSCKTSGYTFTGYYMHWIRQAPGQGLEWMGWINPKSGGTNYAQKFQGRVTMTRDTSISTAYMELSRLRSDDMAVYYCARMGDGAVFDFWGQGTLVTVSS

SEQ ID NO: 1363 - DNA, 24 bp, Artificial Sequence
  synthetic
ggatacaccttcaccggctactat

SEQ ID NO: 1364 - protein, 8 aa, Artificial Sequence
  synthetic
GYTFTGYY

SEQ ID NO: 1365 - DNA, 24 bp, Artificial Sequence
  synthetic
atcaaccctaaaagtggtggcaca

SEQ ID NO: 1366 - protein, 8 aa, Artificial Sequence
  synthetic
INPKSGGT

SEQ ID NO: 1367 - DNA, 33 bp, Artificial Sequence; identical to SEQ ID NO: 1255
  synthetic

SEQ ID NO: 1368 - protein, 11 aa, Artificial Sequence
  synthetic
ARMGDGAVFDF

SEQ ID NO: 1369 - DNA, 327 bp, Artificial Sequence
  synthetic
gacatcgtgatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgctcactttcggcggagggaccaaagtggatatcaaacga

SEQ ID NO: 1370 - protein, 109 aa, Artificial Sequence
  synthetic
DIVMTQSPSSLSASVGDRVTITCRASQSISSYLNWYQQKPGKAPKLLIYAASSLQSGVPSRFSGSGSGTDFTLTISSLQPEDFATYYCQQSYSTPPLTFGGGTKVDIKR

SEQ ID NO: 1371 - DNA, 18 bp, Artificial Sequence
  synthetic
cagagcattagcagctat

SEQ ID NO: 1372 - protein, 6 aa, Artificial Sequence
  synthetic
QSISSY

SEQ ID NO: 1373 - DNA, 9 bp, Artificial Sequence
  synthetic
gctgcatcc

SEQ ID NO: 1374 - protein, 3 aa, Artificial Sequence
  synthetic
AAS

SEQ ID NO: 1375 - DNA, 30 bp, Artificial Sequence
  synthetic
caacagagttacagtacccctccgctcact

SEQ ID NO: 1376 - protein, 10 aa, Artificial Sequence
  synthetic
QQSYSTPPLT

SEQ ID NO: 1377 - DNA, 354 bp, Artificial Sequence
  synthetic
caggttcagctggtgcagtctgggactgaggtgaagaagcctggggcctcagtgaaggtctcctgcaaggcttctggatacaccttcaccggctactatatgcactgggtgcgacaggcccctggacaagggcttgagtggatgggatggatcaaccctaacagtgatgtcacaaactatgcacagaagtttcagggcagggtcaccttgaccagggacacgtccatcagtacagcctacattgacctgagcaggctgagatctgacgacacggccatttattactgtgcgagaatgggggacggtgcagtgtttgactactggggccagggaaccctggtcaccgtctcctca

SEQ ID NO: 1378 - protein, 118 aa, Artificial Sequence
  synthetic
QVQLVQSGTEVKKPGASVKVSCKASGYTFTGYYMHWVRQAPGQGLEWMGWINPNSDVTNYAQKFQGRVTLTRDTSISTAYIDLSRLRSDDTAIYYCARMGDGAVFDYWGQGTLVTVSS

SEQ ID NO: 1379 - DNA, 24 bp, Artificial Sequence
  synthetic
ggatacaccttcaccggctactat

SEQ ID NO: 1380 - protein, 8 aa, Artificial Sequence
  synthetic
GYTFTGYY

SEQ ID NO: 1381 - DNA, 24 bp, Artificial Sequence
  synthetic
atcaaccctaacagtgatgtcaca

SEQ ID NO: 1382 - protein, 8 aa, Artificial Sequence
  synthetic
INPNSDVT

SEQ ID NO: 1383 - DNA, 33 bp, Artificial Sequence; identical to SEQ ID NO: 1335
  synthetic

SEQ ID NO: 1384 - protein, 11 aa, Artificial Sequence
  synthetic
ARMGDGAVFDY

SEQ ID NO: 1385 - DNA, 324 bp, Artificial Sequence
  synthetic
gacatccagatgacccagtctccatcctccctgtctgcatctgtaggagacagagtcaccatcacttgccgggcaagtcagcgcattagcagctatttaaattggtatcagcagaaaccagggaaagcccctaaggtgctgatctctgttgcatccagtttgcaaagtggggtcccatcaaggttcagtggcagtggatctgggacagatttcactctcaccattagtagtctgcaacctgaggattttgcatcttactactgtcaacagagttacaataccccgctcactttcggcggagggaccaaggtggagatcaaacga

SEQ ID NO: 1386 - protein, 108 aa, Artificial Sequence
  synthetic
DIQMTQSPSSLSASVGDRVTITCRASQRISSYLNWYQQKPGKAPKVLISVASSLQSGVPSRFSGSGSGTDFTLTISSLQPEDFASYYCQQSYNTPLTFGGGTKVEIKR

SEQ ID NO: 1387 - DNA, 18 bp, Artificial Sequence
  synthetic
cagcgcattagcagctat

SEQ ID NO: 1388 - protein, 6 aa, Artificial Sequence
  synthetic
QRISSY

SEQ ID NO: 1389 - DNA, 9 bp, Artificial Sequence
  synthetic
gttgcatcc

SEQ ID NO: 1390 - protein, 3 aa, Artificial Sequence
  synthetic
VAS

SEQ ID NO: 1391 - DNA, 27 bp, Artificial Sequence
  synthetic
caacagagttacaataccccgctcact

SEQ ID NO: 1392 - protein, 9 aa, Artificial Sequence
  synthetic
QQSYNTPLT

SEQ ID NO: 1393 - DNA, 381 bp, Artificial Sequence
  synthetic
caggtgcagctggtgcagtctgggggaggcttggtcaagcctggggggtccctgagactctcctgtgcagcctctggattcaccttcagtagctatgacatgagctgggtccgccaggctccagggaaggggctggagtgggtttcatacattagtagtagtggtaataccatacattacgcagactctgtgaagggccgattcaccatctccagagacaattccaagaactcactttatctgcaaatgaacagcctgagagccgaggacacggccgtgtattactgtgcgaaagccggtcccgctacggtgacacggaggtactactactactacggtttggacgtctggggccaagggaccacggtcaccgtctcctca

SEQ ID NO: 1394 - protein, 127 aa, Artificial Sequence
  synthetic
QVQLVQSGGGLVKPGGSLRLSCAASGFTFSSYDMSWVRQAPGKGLEWVSYISSSGNTIHYADSVKGRFTISRDNSKNSLYLQMNSLRAEDTAVYYCAKAGPATVTRRYYYYYGLDVWGQGTTVTVSS

SEQ ID NO: 1395 - DNA, 24 bp, Artificial Sequence
  synthetic
ggattcaccttcagtagctatgac

SEQ ID NO: 1396 - protein, 8 aa, Artificial Sequence
  synthetic
GFTFSSYD

SEQ ID NO: 1397 - DNA, 24 bp, Artificial Sequence
  synthetic
attagtagtagtggtaataccata

SEQ ID NO: 1398 - protein, 8 aa, Artificial Sequence
  synthetic
ISSSGNTI

SEQ ID NO: 1399 - DNA, 60 bp, Artificial Sequence
  synthetic
gcgaaagccggtcccgctacggtgacacggaggtactactactactacggtttggacgtc

SEQ ID NO: 1400 - protein, 20 aa, Artificial Sequence
  synthetic
AKAGPATVTRRYYYYYGLDV

SEQ ID NO: 1401 - DNA, 324 bp, Artificial Sequence
  synthetic
gacatcgtgatgacccagtctccatcctccctgtctgcatctgtacgagacagagtcaccatcacttgccgggcaagtcagagaattagcagctatttaaattggtttcagcagaaaccagggaaagcccctaaggtcctgatctatactgcatccagtttgcaaaatggggtcccatcaaggttcagtggcagtggatctgggacagatttcactctcaccatcagcagtctgcaacctgaagactttgcaacttactactgtcagcagagttacaggaccccgctcactttcggcggagggaccaaggtggagatcaaacga

SEQ ID NO: 1402 - protein, 108 aa, Artificial Sequence
  synthetic
DIVMTQSPSSLSASVRDRVTITCRASQRISSYLNWFQQKPGKAPKVLIYTASSLQNGVPSRFSGSGSGTDFTLTISSLQPEDFATYYCQQSYRTPLTFGGGTKVEIKR

SEQ ID NO: 1403 - DNA, 18 bp, Artificial Sequence
  synthetic
cagagaattagcagctat

SEQ ID NO: 1404 - protein, 6 aa, Artificial Sequence
  synthetic
QRISSY

SEQ ID NO: 1405 - DNA, 9 bp, Artificial Sequence
  synthetic
actgcatcc

SEQ ID NO: 1406 - protein, 3 aa, Artificial Sequence
  synthetic
TAS

SEQ ID NO: 1407 - DNA, 27 bp, Artificial Sequence
  synthetic
cagcagagttacaggaccccgctcact

SEQ ID NO: 1408 - protein, 9 aa, Artificial Sequence
  synthetic
QQSYRTPLT

SEQ ID NO: 1409 - DNA, 354 bp, Artificial Sequence
  synthetic
caggtgcagctggtacagtctggggctgaggtgaagaagcctggggcctcagtgaaggtctcctgcaaggcttctggatacacattcatcggctactatatgcactgggtgcgacaggcccctggacaagggcttgagtggatgggatggatcaaccctaaaagtggtggcacaaactatgcacagaagtttcagggcagggtcaccatgaccggggacacgtccatcagcacagcctacatggagctgagcaggctgagatctgacgacacggccgtgttttactgtgcgagaatgggggacggtgcaatgtttgactactggggccagggaaccctggtcaccgtctcctca

SEQ ID NO: 1410 - protein, 118 aa, Artificial Sequence
  synthetic
QVQLVQSGAEVKKPGASVKVSCKASGYTFIGYYMHWVRQAPGQGLEWMGWINPKSGGTNYAQKFQGRVTMTGDTSISTAYMELSRLRSDDTAVFYCARMGDGAMFDYWGQGTLVTVSS

SEQ ID NO: 1411 - DNA, 24 bp, Artificial Sequence
  synthetic
ggatacacattcatcggctactat

SEQ ID NO: 1412 - protein, 8 aa, Artificial Sequence
  synthetic
GYTFIGYY

SEQ ID NO: 1413 - DNA, 24 bp, Artificial Sequence
  synthetic
atcaaccctaaaagtggtggcaca

SEQ ID NO: 1414 - protein, 8 aa, Artificial Sequence
  synthetic
INPKSGGT

SEQ ID NO: 1415 - DNA, 33 bp, Artificial Sequence
  synthetic
gcgagaatgggggacggtgcaatgtttgactac

SEQ ID NO: 1416 - protein, 11 aa, Artificial Sequence
  synthetic
ARMGDGAMFDY

SEQ ID NO: 1417 - DNA, 321 bp, Artificial Sequence
  synthetic
gacatccagatgacccagtctccatcctccctgtctgcatctgtaggagacagagtcaccatcacttgccgggcaagtcagagaattagcagctatttaaattggtatcagcagaaagcagggaaagcccctaaggtcctgatctatactgcatccagtttgcaaagtggggtcccatcacgattcagtggcagtggatctgggacagatttcactctcaccatcagcagtctgcaacctgaagattttgcaacttactactgtcaacagagttacagtaccccgctcactttcggcggagggaccaaggtggagatcaaa

SEQ ID NO: 1418 - protein, 107 aa, Artificial Sequence
  synthetic
DIQMTQSPSSLSASVGDRVTITCRASQRISSYLNWYQQKAGKAPKVLIYTASSLQSGVPSRFSGSGSGTDFTLTISSLQPEDFATYYCQQSYSTPLTFGGGTKVEIK

SEQ ID NO: 1419 - DNA, 18 bp, Artificial Sequence
  synthetic
cagagaattagcagctat

SEQ ID NO: 1420 - protein, 6 aa, Artificial Sequence
  synthetic
QRISSY

SEQ ID NO: 1421 - DNA, 9 bp, Artificial Sequence
  synthetic
actgcatcc

SEQ ID NO: 1422 - protein, 3 aa, Artificial Sequence
  synthetic
TAS

SEQ ID NO: 1423 - DNA, 27 bp, Artificial Sequence
  synthetic
caacagagttacagtaccccgctcact

SEQ ID NO: 1424 - protein, 9 aa, Artificial Sequence
  synthetic
QQSYSTPLT

SEQ ID NO: 1425 - DNA, 375 bp, Artificial Sequence
  synthetic
caggtgcagctggtacagtctgggggaggcgtggtacagcctggggggtccctgagactctcctgtgcagcctctggattcacctttgatgattatgccatgcactgggtccgtcaagctccagggaagggtctggagtgggtctctcttattagtggggatggtggtagcacatactatgcagactctgtgaagggccgattcaccatctccagagacaacagcaaaaactccctgtatctgcaaatgaacagtctgagaactgaggacaccgccttgtattactgtgcaaaagatgatagcagctcgtcctggtactactactactacggtatggacgtctggggccgagggaccacggtcaccgtctcctca

SEQ ID NO: 1426 - protein, 125 aa, Artificial Sequence
  synthetic
QVQLVQSGGGVVQPGGSLRLSCAASGFTFDDYAMHWVRQAPGKGLEWVSLISGDGGSTYYADSVKGRFTISRDNSKNSLYLQMNSLRTEDTALYYCAKDDSSSSWYYYYYGMDVWGRGTTVTVSS

SEQ ID NO: 1427 - DNA, 24 bp, Artificial Sequence
  synthetic
ggattcacctttgatgattatgcc

SEQ ID NO: 1428 - protein, 8 aa, Artificial Sequence
  synthetic
GFTFDDYA

SEQ ID NO: 1429 - DNA, 24 bp, Artificial Sequence
  synthetic
attagtggggatggtggtagcaca

SEQ ID NO: 1430 - protein, 8 aa, Artificial Sequence
  synthetic
ISGDGGST

SEQ ID NO: 1431 - DNA, 54 bp, Artificial Sequence
  synthetic
gcaaaagatgatagcagctcgtcctggtactactactactacggtatggacgtc

SEQ ID NO: 1432 - protein, 18 aa, Artificial Sequence
  synthetic
AKDDSSSSWYYYYYGMDV

SEQ ID NO: 1433 - DNA, 324 bp, Artificial Sequence
  synthetic
gacatccagatgacccagtctccatcctccctgtctgcatctgtaggagacagagtcaccatcacttgccgggcaagtcagcgcattagcagctatttaaattggtatcagcagaaaccagggaaagcccctaaggtgctgatctctgttgcatccagtttgcaaagtggggtcccatcaaggttcagtggcagtggatctgggacagatttcactctcaccatcagcagtctgcaacctgaggattttgcatcttactactgtcaacagagttacaataccccgctcactttcggcggagggaccaaggtggagatcaaacga

SEQ ID NO: 1434 - protein, 108 aa, Artificial Sequence; identical to SEQ ID NO: 1386
  synthetic

SEQ ID NO: 1435 - DNA, 18 bp, Artificial Sequence
  synthetic
cagcgcattagcagctat

SEQ ID NO: 1436 - protein, 6 aa, Artificial Sequence
  synthetic
QRISSY

SEQ ID NO: 1437 - DNA, 9 bp, Artificial Sequence
  synthetic
gttgcatcc

SEQ ID NO: 1438 - protein, 3 aa, Artificial Sequence
  synthetic
VAS

SEQ ID NO: 1439 - DNA, 27 bp, Artificial Sequence
  synthetic
caacagagttacaataccccgctcact

SEQ ID NO: 1440 - protein, 9 aa, Artificial Sequence
  synthetic
QQSYNTPLT

SEQ ID NO: 1441 - DNA, 372 bp, Artificial Sequence
  synthetic
gaggtgcagctggtggagtctgggggaggcttggtacagcctggcaggtccctgagactctcctgtgcagcctctggattcacctttggtgattataccatgcactgggtccggcaagctccagggaagggcctggagtgggtctccgatattagttggaatagtggtagcaaagactatgcggactctgtgaagggccgattcaccatctccagagacaacgccaagaactccctctatcttcaaatgaacagtctgagaactgaggatacggccttttattactgtgcaaaagatagtaggggctacggtctctactaccacctcggtttggacgtctggggccaagggaccacggtcaccgtctcctca

SEQ ID NO: 1442 - protein, 124 aa, Artificial Sequence
  synthetic
EVQLVESGGGLVQPGRSLRLSCAASGFTFGDYTMHWVRQAPGKGLEWVSDISWNSGSKDYADSVKGRFTISRDNAKNSLYLQMNSLRTEDTAFYYCAKDSRGYGLYYHLGLDVWGQGTTVTVSS

SEQ ID NO: 1443 - DNA, 24 bp, Artificial Sequence
  synthetic
ggattcacctttggtgattatacc

SEQ ID NO: 1444 - protein, 8 aa, Artificial Sequence
  synthetic
GFTFGDYT

SEQ ID NO: 1445 - DNA, 24 bp, Artificial Sequence
  synthetic
attagttggaatagtggtagcaaa

SEQ ID NO: 1446 - protein, 8 aa, Artificial Sequence
  synthetic
ISWNSGSK

SEQ ID NO: 1447 - DNA, 51 bp, Artificial Sequence
  synthetic
gcaaaagatagtaggggctacggtctctactaccacctcggtttggacgtc

SEQ ID NO: 1448 - protein, 17 aa, Artificial Sequence
  synthetic
AKDSRGYGLYYHLGLDV

SEQ ID NO: 1449 - DNA, 372 bp, Artificial Sequence
  synthetic
gaggtgcagctggtggagtctgggggaggcttggtgcagcctggcaggtccctgagactctcctgtgcagcctctggattcacctttgctgattataccatgcactgggtccggcaagctccagggaagggcctggagtgggtctcagatattagttggaatagtggtagtatagcctatgcggactctgtgaagggccgattcaccatctccagagacaacgccaagaactccctctatcttcaaatgaacagtctgagaactgaggacacggccttttattactgtgcaaaagatagtaggggctacggtcactataagtacctcggtttggacgtctggggccaagggaccacggtcaccgtctcctca

SEQ ID NO: 1450 - protein, 124 aa, Artificial Sequence
  synthetic
EVQLVESGGGLVQPGRSLRLSCAASGFTFADYTMHWVRQAPGKGLEWVSDISWNSGSIAYADSVKGRFTISRDNAKNSLYLQMNSLRTEDTAFYYCAKDSRGYGHYKYLGLDVWGQGTTVTVSS

SEQ ID NO: 1451 - DNA, 24 bp, Artificial Sequence
  synthetic
ggattcacctttgctgattatacc

SEQ ID NO: 1452 - protein, 8 aa, Artificial Sequence
  synthetic
GFTFADYT

SEQ ID NO: 1453 - DNA, 24 bp, Artificial Sequence
  synthetic
attagttggaatagtggtagtata

SEQ ID NO: 1454 - protein, 8 aa, Artificial Sequence
  synthetic
ISWNSGSI

SEQ ID NO: 1455 - DNA, 51 bp, Artificial Sequence
  synthetic
gcaaaagatagtaggggctacggtcactataagtacctcggtttggacgtc

SEQ ID NO: 1456 - protein, 17 aa, Artificial Sequence
  synthetic
AKDSRGYGHYKYLGLDV

SEQ ID NO: 1457 - DNA, 372 bp, Artificial Sequence
  synthetic
gaggtgcagctggtggagtctgggggaggcatggtacagcctggcaggtccctgagactctcctgtgcagcctctggattccccttcaatgattacaccatgcactgggtccggcaagtcccagggaggggcctggagtgggtctcagatattagttggaatagcggcagtaaaggctatgcggactctgtgaagggtcgattcatcatctccagagacaacgccaagaactccctgtacctgcaaatgaacagtctgagagttgaagacacggccttgtattactgtgtaaaagatggaagtggctacgggaggttccattattacgctatggacgtctggggccaagggaccacggtcaccgtctcctca

SEQ ID NO: 1458 - protein, 124 aa, Artificial Sequence
  synthetic
EVQLVESGGGMVQPGRSLRLSCAASGFPFNDYTMHWVRQVPGRGLEWVSDISWNSGSKGYADSVKGRFIISRDNAKNSLYLQMNSLRVEDTALYYCVKDGSGYGRFHYYAMDVWGQGTTVTVSS

SEQ ID NO: 1459 - DNA, 24 bp, Artificial Sequence
  synthetic
ggattccccttcaatgattacacc

SEQ ID NO: 1460 - protein, 8 aa, Artificial Sequence
  synthetic
GFPFNDYT

SEQ ID NO: 1461 - DNA, 24 bp, Artificial Sequence
  synthetic
attagttggaatagcggcagtaaa

SEQ ID NO: 1462 - protein, 8 aa, Artificial Sequence
  synthetic
ISWNSGSK

SEQ ID NO: 1463 - DNA, 51 bp, Artificial Sequence
  synthetic
gtaaaagatggaagtggctacgggaggttccattattacgctatggacgtc

SEQ ID NO: 1464 - protein, 17 aa, Artificial Sequence
  synthetic
VKDGSGYGRFHYYAMDV

SEQ ID NO: 1465 - DNA, 372 bp, Artificial Sequence
  synthetic
gaggtgcagctggtggagtctggtggaggcttggtacagcctggcaggtccctgagactctcctgtgcagcctctggattcacctttgctgattataccatgcactgggtccgccaagttccagggaagggcctggagtgggtctcagatattagttggaatagtggtagcaaagactatgcggactctgtgaagggccgcttcaccatctccagagacaacgccaagaatttcctgtatctgcaaatgaacagtctgagagctgaagacacggccttgtattactgtgtaaaatatggaagtggctacgggaaattctacttctacgctatggacgtctggggccaagggaccacggtcaccgtctcctca

SEQ ID NO: 1466 - protein, 124 aa, Artificial Sequence
  synthetic
EVQLVESGGGLVQPGRSLRLSCAASGFTFADYTMHWVRQVPGKGLEWVSDISWNSGSKDYADSVKGRFTISRDNAKNFLYLQMNSLRAEDTALYYCVKYGSGYGKFYFYAMDVWGQGTTVTVSS

SEQ ID NO: 1467 - DNA, 24 bp, Artificial Sequence
  synthetic
ggattcacctttgctgattatacc

SEQ ID NO: 1468 - protein, 8 aa, Artificial Sequence
  synthetic
GFTFADYT

SEQ ID NO: 1469 - DNA, 24 bp, Artificial Sequence
  synthetic
attagttggaatagtggtagcaaa

SEQ ID NO: 1470 - protein, 8 aa, Artificial Sequence
  synthetic
ISWNSGSK

SEQ ID NO: 1471 - DNA, 51 bp, Artificial Sequence
  synthetic
gtaaaatatggaagtggctacgggaaattctacttctacgctatggacgtc

SEQ ID NO: 1472 - protein, 17 aa, Artificial Sequence
  synthetic
VKYGSGYGKFYFYAMDV

SEQ ID NO: 1473 - DNA, 372 bp, Artificial Sequence
  synthetic
gaggtgcagctggtgcagtctgggggaggcttggtacagcctggcaggtccctgagactctcctgtgcagcctctggattcacctttgctgattataccatgcactgggtccggcaaactccagggaagggcctggagtgggtctcaggtattagttggaatagtggtagcaaagactatgcggactctgtgaagggccgattcaccatctccagagacaacgccaagaactccctgtatctgcaaatgaacagtctgagaactgaggacacggccttgtattactgtgcaaaatatggaagtggctacgggagatatttcttctacgctatggacgtctggggccaagggaccacggtcaccgtctcctca

SEQ ID NO: 1474 - protein, 124 aa, Artificial Sequence
  synthetic
EVQLVQSGGGLVQPGRSLRLSCAASGFTFADYTMHWVRQTPGKGLEWVSGISWNSGSKDYADSVKGRFTISRDNAKNSLYLQMNSLRTEDTALYYCAKYGSGYGRYFFYAMDVWGQGTTVTVSS

SEQ ID NO: 1475 - DNA, 24 bp, Artificial Sequence
  synthetic
ggattcacctttgctgattatacc

SEQ ID NO: 1476 - protein, 8 aa, Artificial Sequence
  synthetic
GFTFADYT

SEQ ID NO: 1477 - DNA, 24 bp, Artificial Sequence
  synthetic
attagttggaatagtggtagcaaa

SEQ ID NO: 1478 - protein, 8 aa, Artificial Sequence
  synthetic
ISWNSGSK

SEQ ID NO: 1479 - DNA, 51 bp, Artificial Sequence
  synthetic
gcaaaatatggaagtggctacgggagatatttcttctacgctatggacgtc

SEQ ID NO: 1480 - protein, 17 aa, Artificial Sequence
  synthetic
AKYGSGYGRYFFYAMDV

SEQ ID NO: 1481 - DNA, 372 bp, Artificial Sequence
  synthetic
gaggtgcagctggtggagtcaaggggagccttggtacagcctggcaggtccctgagactctcctgtgcagcctctggattcgcctttaatgattataccatgcactgggtccggcaagctccagggaagggcctggagtgggtctcagatattagttggaatagtaatagtaaagactatgcggactctgtgaagggccgattcaccatctccagagacaatgccaagaactccctctatctacaaatgaacagtctgagagctgaggacacggccttgtattactgtgtaaaagatggaagtggctacgggaaattttccctctacgctttggacgtctggggccaagggaccacggtcaccgtctcctca

SEQ ID NO: 1482 - protein, 124 aa, Artificial Sequence
  synthetic
EVQLVESRGALVQPGRSLRLSCAASGFAFNDYTMHWVRQAPGKGLEWVSDISWNSNSKDYADSVKGRFTISRDNAKNSLYLQMNSLRAEDTALYYCVKDGSGYGKFSLYALDVWGQGTTVTVSS

SEQ ID NO: 1483 - DNA, 24 bp, Artificial Sequence
  synthetic
ggattcgcctttaatgattatacc

SEQ ID NO: 1484 - protein, 8 aa, Artificial Sequence
  synthetic
GFAFNDYT

SEQ ID NO: 1485 - DNA, 24 bp, Artificial Sequence
  synthetic
attagttggaatagtaatagtaaa

SEQ ID NO: 1486 - protein, 8 aa, Artificial Sequence
  synthetic
ISWNSNSK

SEQ ID NO: 1487 - DNA, 51 bp, Artificial Sequence
  synthetic
gtaaaagatggaagtggctacgggaaattttccctctacgctttggacgtc

SEQ ID NO: 1488 - protein, 17 aa, Artificial Sequence
  synthetic
VKDGSGYGKFSLYALDV

SEQ ID NO: 1489 - DNA, 372 bp, Artificial Sequence
  synthetic
caggtgcagctggtggagtctgggggaggcttggttcaccctggcaggtccctgagactctcctgtgcagcctctggattcaaatttgatgattataccatgcactgggtccggcaagctccagggaagggcctagagtgggtctcagatattagttggaatagtggtagtaaaggctatgcggactctgtgaagggccgattcaccatctccagagacaacgccaaggattccctatatctgcagatggacagtctgagagctgcagacacggccttctattactgtgcaaaagataaaagtggctacggccacttctactactacgctatggacgtctggggccaagggaccacggtcaccgtctcctca

SEQ ID NO: 1490 - protein, 124 aa, Artificial Sequence
  synthetic
QVQLVESGGGLVHPGRSLRLSCAASGFKFDDYTMHWVRQAPGKGLEWVSDISWNSGSKGYADSVKGRFTISRDNAKDSLYLQMDSLRAADTAFYYCAKDKSGYGHFYYYAMDVWGQGTTVTVSS

SEQ ID NO: 1491 - DNA, 24 bp, Artificial Sequence
  synthetic
ggattcaaatttgatgattatacc

SEQ ID NO: 1492 - protein, 8 aa, Artificial Sequence
  synthetic
GFKFDDYT

SEQ ID NO: 1493 - DNA, 24 bp, Artificial Sequence
  synthetic
attagttggaatagtggtagtaaa

SEQ ID NO: 1494 - protein, 8 aa, Artificial Sequence
  synthetic
ISWNSGSK

SEQ ID NO: 1495 - DNA, 51 bp, Artificial Sequence
  synthetic
gcaaaagataaaagtggctacggccacttctactactacgctatggacgtc

SEQ ID NO: 1496 - protein, 17 aa, Artificial Sequence
  synthetic
AKDKSGYGHFYYYAMDV

SEQ ID NO: 1497 - DNA, 372 bp, Artificial Sequence
  synthetic
gaggtgcagctggtggagtctgggggaggcttggtacaccctggcaggtccctaagactctcctgtacagcctctggattcaagtttgctgattataccatgcactgggtccggcaagctccagggaagggcctggagtgggtctcagatattagttggaatagtggtagtaaaggctatgcggactctgtaaagggccgattcaccatctccagagacaatgacaagaactccctgtatctgcaaatgaacagtctgagaggtgaggacacggccttgtattactgtgcaaaagatggaagtggctacgggaggttccacttctacgctatcgacgtctggggccaagggaccacggtcaccgtctcctca

SEQ ID NO: 1498 - protein, 124 aa, Artificial Sequence
  synthetic
EVQLVESGGGLVHPGRSLRLSCTASGFKFADYTMHWVRQAPGKGLEWVSDISWNSGSKGYADSVKGRFTISRDNDKNSLYLQMNSLRGEDTALYYCAKDGSGYGRFHFYAIDVWGQGTTVTVSS

SEQ ID NO: 1499 - DNA, 24 bp, Artificial Sequence
  synthetic
ggattcaagtttgctgattatacc

SEQ ID NO: 1500 - protein, 8 aa, Artificial Sequence
  synthetic
GFKFADYT

SEQ ID NO: 1501 - DNA, 24 bp, Artificial Sequence
  synthetic
attagttggaatagtggtagtaaa

SEQ ID NO: 1502 - protein, 8 aa, Artificial Sequence
  synthetic
ISWNSGSK

SEQ ID NO: 1503 - DNA, 51 bp, Artificial Sequence
  synthetic
gcaaaagatggaagtggctacgggaggttccacttctacgctatcgacgtc

SEQ ID NO: 1504 - protein, 17 aa, Artificial Sequence
  synthetic
AKDGSGYGRFHFYAIDV

SEQ ID NO: 1505 - DNA, 372 bp, Artificial Sequence
  synthetic
gaggtgcagctggtggagtctgggggaggcttggtacagcctggcaggtccctgagactctcctgtgtagcctctggattcacctttgatgattattccatgcactgggtccggcaagctccagggaagggcctggagtgggtctcaggtattagttggaatagtggtagcaaagactatgcggactctgtgaagggccgattcaccatctccagagacaacgccaagaactccctgtatctgcaaatgaacagtctgagagctgaagacacggccttgtattactgtgcaaaatatggaagtggctacgggaagttctaccactacggtttggacgtctggggccaagggaccacggtcaccgtctcctca

SEQ ID NO: 1506 - protein, 124 aa, Artificial Sequence
  synthetic
EVQLVESGGGLVQPGRSLRLSCVASGFTFDDYSMHWVRQAPGKGLEWVSGISWNSGSKDYADSVKGRFTISRDNAKNSLYLQMNSLRAEDTALYYCAKYGSGYGKFYHYGLDVWGQGTTVTVSS

SEQ ID NO: 1507 - DNA, 24 bp, Artificial Sequence
  synthetic
ggattcacctttgatgattattcc

SEQ ID NO: 1508 - protein, 8 aa, Artificial Sequence
  synthetic
GFTFDDYS

SEQ ID NO: 1509 - DNA, 24 bp, Artificial Sequence
  synthetic
attagttggaatagtggtagcaaa

SEQ ID NO: 1510 - protein, 8 aa, Artificial Sequence
  synthetic
ISWNSGSK

SEQ ID NO: 1511 - DNA, 51 bp, Artificial Sequence
  synthetic
gcaaaatatggaagtggctacgggaagttctaccactacggtttggacgtc

SEQ ID NO: 1512 - protein, 17 aa, Artificial Sequence
  synthetic
AKYGSGYGKFYHYGLDV

SEQ ID NO: 1513 - DNA, 372 bp, Artificial Sequence
  synthetic
caggtgcagttggtggagtctgggggaggcttggtacagcctggcaggtccctgagactctcctgtgcagcctctggattcacctttgctgattataccatgcactgggtccggcaggctccagggaagggcctggagtgggtctcagatattagttggaatagtggtagcatgggctatgcggactctgtgaagggccgattcaccatctccagagacaacgccaagaaatccctgtatctgcaaatgaacagtctgagaactgaggacacggccttgtattactgtgcaaaagatggaagtggctacgggaaatacttcttctacgctatggacgtctggggccaagggaccacggtcaccgtctcctca

SEQ ID NO: 1514 - protein, 124 aa, Artificial Sequence
  synthetic
QVQLVESGGGLVQPGRSLRLSCAASGFTFADYTMHWVRQAPGKGLEWVSDISWNSGSMGYADSVKGRFTISRDNAKKSLYLQMNSLRTEDTALYYCAKDGSGYGKYFFYAMDVWGQGTTVTVSS

SEQ ID NO: 1515 - DNA, 24 bp, Artificial Sequence
  synthetic
ggattcacctttgctgattatacc

SEQ ID NO: 1516 - protein, 8 aa, Artificial Sequence
  synthetic
GFTFADYT

SEQ ID NO: 1517 - DNA, 24 bp, Artificial Sequence
  synthetic
attagttggaatagtggtagcatg

SEQ ID NO: 1518 - protein, 8 aa, Artificial Sequence
  synthetic
ISWNSGSM

SEQ ID NO: 1519 - DNA, 51 bp, Artificial Sequence
  synthetic
gcaaaagatggaagtggctacgggaaatacttcttctacgctatggacgtc

SEQ ID NO: 1520 - protein, 17 aa, Artificial Sequence
  synthetic
AKDGSGYGKYFFYAMDV

SEQ ID NO: 1521 - DNA, 372 bp, Artificial Sequence
  synthetic
gaggtgcagctggtgcagtctgggggaggcttggtacagcctggcaggtccctgagactctcctgtgcagcctctggattcaccttttctgattatactatgcattgggtccggcaaggtccagggaagggcctggagtgggtctcagatattagttggaatagtggtagtaaaggctatacggactctgtgaagggccgattcaccatttccagagacaacgccaagaagtccctgtatctacaaatgaacagtctgagagctgaggacacggccttgtactactgtgtaaaagatggaagtggctacgggaaataccacttctacgctatggacgtctggggccaagggaccctggtcaccgtctcctca

SEQ ID NO: 1522 - protein, 124 aa, Artificial Sequence
  synthetic
EVQLVQSGGGLVQPGRSLRLSCAASGFTFSDYTMHWVRQGPGKGLEWVSDISWNSGSKGYTDSVKGRFTISRDNAKKSLYLQMNSLRAEDTALYYCVKDGSGYGKYHFYAMDVWGQGTLVTVSS

SEQ ID NO: 1523 - DNA, 24 bp, Artificial Sequence
  synthetic
ggattcaccttttctgattatact

SEQ ID NO: 1524 - protein, 8 aa, Artificial Sequence
  synthetic
GFTFSDYT

SEQ ID NO: 1525 - DNA, 24 bp, Artificial Sequence
  synthetic
attagttggaatagtggtagtaaa

SEQ ID NO: 1526 - protein, 8 aa, Artificial Sequence
  synthetic
ISWNSGSK

SEQ ID NO: 1527 - DNA, 51 bp, Artificial Sequence
  synthetic
gtaaaagatggaagtggctacgggaaataccacttctacgctatggacgtc

SEQ ID NO: 1528 - protein, 17 aa, Artificial Sequence
  synthetic
VKDGSGYGKYHFYAMDV

SEQ ID NO: 1529 - DNA, 372 bp, Artificial Sequence
  synthetic
gaggtgcagctggtggagtcggggggaggcttggttcaccctggcaggtccctgagactctcctgtgcagcctctggattcacctttgatgattataccatgcactgggtccggcaagctccagggaagggcctggaatgggtctcagatattagttggaatagtggtagcagaggctatgcggactctgtgaagggccgattcaccatctccagagataatgccgagaactccctgtacctgcaaatgaacagtctgagagctgaggacacggccttgtattactgtgcaaaagataaaagtggctacggccactactactactacgctatggacgtctggggccaagggaccacggtcaccgtctcctca

SEQ ID NO: 1530 - protein, 124 aa, Artificial Sequence
  synthetic
EVQLVESGGGLVHPGRSLRLSCAASGFTFDDYTMHWVRQAPGKGLEWVSDISWNSGSRGYADSVKGRFTISRDNAENSLYLQMNSLRAEDTALYYCAKDKSGYGHYYYYAMDVWGQGTTVTVSS

SEQ ID NO: 1531 - DNA, 24 bp, Artificial Sequence
  synthetic
ggattcacctttgatgattatacc

SEQ ID NO: 1532 - protein, 8 aa, Artificial Sequence
  synthetic
GFTFDDYT

SEQ ID NO: 1533 - DNA, 24 bp, Artificial Sequence
  synthetic
attagttggaatagtggtagcaga

SEQ ID NO: 1534 - protein, 8 aa, Artificial Sequence
  synthetic
ISWNSGSR

SEQ ID NO: 1535 - DNA, 51 bp, Artificial Sequence
  synthetic
gcaaaagataaaagtggctacggccactactactactacgctatggacgtc

SEQ ID NO: 1536 - protein, 17 aa, Artificial Sequence
  synthetic
AKDKSGYGHYYYYAMDV

SEQ ID NO: 1537 - DNA, 372 bp, Artificial Sequence
  synthetic
gaggtgcagctggtggagtctgggggaggcttggtacagcctggcgggtccctgagactctcctgtgaagcctctggattcacctttgctgattataccttgcactgggtccggcaagctccagggaagggcctggaatgggtctcagatattagttggaatagtggcaccagaggctatgcggactctgtgaggggccgattcaccatctccagagacaacgccaagaagtccctgtatctgcaaatgaacagtctgagatctgaggacacggccttgtattactgtgtgaaagatggaagtggctacgggagatataatttctacgctatggacgtctggggccaagggaccacggtcaccgtctcctca

SEQ ID NO: 1538 - protein, 124 aa, Artificial Sequence
  synthetic
EVQLVESGGGLVQPGGSLRLSCEASGFTFADYTLHWVRQAPGKGLEWVSDISWNSGTRGYADSVRGRFTISRDNAKKSLYLQMNSLRSEDTALYYCVKDGSGYGRYNFYAMDVWGQGTTVTVSS

SEQ ID NO: 1539 - DNA, 24 bp, Artificial Sequence
  synthetic
ggattcacctttgctgattatacc

SEQ ID NO: 1540 - protein, 8 aa, Artificial Sequence
  synthetic
GFTFADYT

SEQ ID NO: 1541 - DNA, 24 bp, Artificial Sequence
  synthetic
attagttggaatagtggcaccaga

SEQ ID NO: 1542 - protein, 8 aa, Artificial Sequence
  synthetic
ISWNSGTR

SEQ ID NO: 1543 - DNA, 51 bp, Artificial Sequence
  synthetic
gtgaaagatggaagtggctacgggagatataatttctacgctatggacgtc

SEQ ID NO: 1544 - protein, 17 aa, Artificial Sequence
  synthetic
VKDGSGYGRYNFYAMDV

SEQ ID NO: 1545 - DNA, 369 bp, Artificial Sequence
  synthetic
gaggtgcagctggtggagtctgggggaggcttggttcagcctggcaggtccctgagactctcctgtgcagcctctggatttacctttgctgactataccatgcactgggtccggcaaggtccagggaagggcctggagtgggtctcagatattggttggaatagtaatactataggctatgcggactctgtgaagggccgattcgccatctccagagacaacgccaagaactccctgtatcttcaaatgaacagtctgcgacctgaggacacggccttatattactgtgtaaaggataaaagtggctacgggaaattccaatacggtttggacgtctggggccaagggaccacggtcaccgtctcctca

SEQ ID NO: 1546 - protein, 123 aa, Artificial Sequence
  synthetic
EVQLVESGGGLVQPGRSLRLSCAASGFTFADYTMHWVRQGPGKGLEWVSDIGWNSNTIGYADSVKGRFAISRDNAKNSLYLQMNSLRPEDTALYYCVKDKSGYGKFQYGLDVWGQGTTVTVSS

SEQ ID NO: 1547 - DNA, 24 bp, Artificial Sequence
  synthetic
ggatttacctttgctgactatacc

SEQ ID NO: 1548 - protein, 8 aa, Artificial Sequence
  synthetic
GFTFADYT

SEQ ID NO: 1549 - DNA, 24 bp, Artificial Sequence
  synthetic
attggttggaatagtaatactata

SEQ ID NO: 1550 - protein, 8 aa, Artificial Sequence
  synthetic
IGWNSNTI

SEQ ID NO: 1551 - DNA, 48 bp, Artificial Sequence
  synthetic
gtaaaggataaaagtggctacgggaaattccaatacggtttggacgtc

SEQ ID NO: 1552 - protein, 16 aa, Artificial Sequence
  synthetic
VKDKSGYGKFQYGLDV

SEQ ID NO: 1553 - DNA, 369 bp, Artificial Sequence
  synthetic
gaggtgcagctggtggagtctgggggaggcttggtacagcctggcaggtccctgagactctcctgtgcagcctctggatttacatttgacgattataccatgcactgggtccggcaaggtccagggaagggcctggagtgggtctcagatattggttggaatagtaacagtataggctatgcggactctgtgaagggccgattcaccatctccagagacaacgccaagaactccctgtatctccaaatgaacagtctgagacctgaggacacggccttgtatttctgtgtaaaggataaaagtggctacgggaaatttttcatcggtttggacgtctggggccaagggacaatggtcaccgtctcttca

SEQ ID NO: 1554 - protein, 123 aa, Artificial Sequence
  synthetic
EVQLVESGGGLVQPGRSLRLSCAASGFTFDDYTMHWVRQGPGKGLEWVSDIGWNSNSIGYADSVKGRFTISRDNAKNSLYLQMNSLRPEDTALYFCVKDKSGYGKFFIGLDVWGQGTMVTVSS

SEQ ID NO: 1555 - DNA, 24 bp, Artificial Sequence
  synthetic
ggatttacatttgacgattatacc

SEQ ID NO: 1556 - protein, 8 aa, Artificial Sequence
  synthetic
GFTFDDYT

SEQ ID NO: 1557 - DNA, 24 bp, Artificial Sequence
  synthetic
attggttggaatagtaacagtata

SEQ ID NO: 1558 - protein, 8 aa, Artificial Sequence
  synthetic
IGWNSNSI

SEQ ID NO: 1559 - DNA, 48 bp, Artificial Sequence
  synthetic
gtaaaggataaaagtggctacgggaaatttttcatcggtttggacgtc

SEQ ID NO: 1560 - protein, 16 aa, Artificial Sequence
  synthetic
VKDKSGYGKFFIGLDV

SEQ ID NO: 1561 - DNA, 369 bp, Artificial Sequence
  synthetic
caggtgcagttggtggagtctgggggaggcttggtacagcctggcaggtccctgagactctcctgtgcagcctctggatttacatttgacgattataccatgcactgggtccggcaaggtccagggaagggcctggagtgggtctcagatattggttggaatagtaatactaaaggctatgcggactctgtgaagggccgattcaccatctccagagacaacgccaagaattccctgtatctccaaatgaacagtctgagacctgaggacacggccttgtatttctgtgtgaaggataaaagtggctacgggaaatttttcatcggtttggacgtctggggccaagggacaatggtcaccgtctcttca

SEQ ID NO: 1562 - protein, 123 aa, Artificial Sequence
  synthetic
QVQLVESGGGLVQPGRSLRLSCAASGFTFDDYTMHWVRQGPGKGLEWVSDIGWNSNTKGYADSVKGRFTISRDNAKNSLYLQMNSLRPEDTALYFCVKDKSGYGKFFIGLDVWGQGTMVTVSS

SEQ ID NO: 1563 - DNA, 24 bp, Artificial Sequence
  synthetic
ggatttacatttgacgattatacc

SEQ ID NO: 1564 - protein, 8 aa, Artificial Sequence
  synthetic
GFTFDDYT

SEQ ID NO: 1565 - DNA, 24 bp, Artificial Sequence
  synthetic
attggttggaatagtaatactaaa

SEQ ID NO: 1566 - protein, 8 aa, Artificial Sequence
  synthetic
IGWNSNTK

SEQ ID NO: 1567 - DNA, 48 bp, Artificial Sequence
  synthetic
gtgaaggataaaagtggctacgggaaatttttcatcggtttggacgtc

SEQ ID NO: 1568 - protein, 16 aa, Artificial Sequence
  synthetic
VKDKSGYGKFFIGLDV

SEQ ID NO: 1569 - DNA, 369 bp, Artificial Sequence
  synthetic
gaggtgcagctggtggagtctgggggaggcttggtccagcctgggcggtccctgagactctcctgtgcagcctccggattcacctttgctgattataccatgcactgggtccggcaaggtccagggacgggcctggagtgggtctcagatattggttggagtggtggtagtttaggctatgcggactctgtgaagggccgattcaccatctccagagacaacgccaagaactccctgtatttggaaatgaacaatctgcgacctgaagacacggccttgtattattgtgtaaaggataaaagtggctacgggaaattccagtacggtttggacgtctggggccaagggaccacggtcaccgtctcctca

SEQ ID NO: 1570 - protein, 123 aa, Artificial Sequence
  synthetic
EVQLVESGGGLVQPGRSLRLSCAASGFTFADYTMHWVRQGPGTGLEWVSDIGWSGGSLGYADSVKGRFTISRDNAKNSLYLEMNNLRPEDTALYYCVKDKSGYGKFQYGLDVWGQGTTVTVSS

SEQ ID NO: 1571 - DNA, 24 bp, Artificial Sequence
  synthetic
ggattcacctttgctgattatacc

SEQ ID NO: 1572 - protein, 8 aa, Artificial Sequence
  synthetic
GFTFADYT

SEQ ID NO: 1573 - DNA, 24 bp, Artificial Sequence
  synthetic
attggttggagtggtggtagttta

SEQ ID NO: 1574 - protein, 8 aa, Artificial Sequence
  synthetic
IGWSGGSL

SEQ ID NO: 1575 - DNA, 48 bp, Artificial Sequence
  synthetic
gtaaaggataaaagtggctacgggaaattccagtacggtttggacgtc

SEQ ID NO: 1576 - protein, 16 aa, Artificial Sequence
  synthetic
VKDKSGYGKFQYGLDV

SEQ ID NO: 1577 - DNA, 369 bp, Artificial Sequence
  synthetic
gaggtgcagctggtggagtctgggggaggcgtggtacagcctggcaggtccctgagactctcctgtgcagcctctgggtttaaatttgatggttataccatgcactgggtccggcaaggtccagggaagggcctggagtgggtctcagatattggttggaatagtaacactataggctatgcggactctgtgaagggccgattcaccatctccagagacaacgccaagaactccctgtatctccaaatgaacagtctgagaccagaggacacggccttgtatttctgtgtaaaggataaaagtggctacgggaaatttttcatcggtttggacgtctggggccaagggacaatggtcaccgtctcttca

SEQ ID NO: 1578 - protein, 123 aa, Artificial Sequence
  synthetic
EVQLVESGGGVVQPGRSLRLSCAASGFKFDGYTMHWVRQGPGKGLEWVSDIGWNSNTIGYADSVKGRFTISRDNAKNSLYLQMNSLRPEDTALYFCVKDKSGYGKFFIGLDVWGQGTMVTVSS

SEQ ID NO: 1579 - DNA, 24 bp, Artificial Sequence
  synthetic
gggtttaaatttgatggttatacc

SEQ ID NO: 1580 - protein, 8 aa, Artificial Sequence
  synthetic
GFKFDGYT

SEQ ID NO: 1581 - DNA, 24 bp, Artificial Sequence
  synthetic
attggttggaatagtaacactata

SEQ ID NO: 1582 - protein, 8 aa, Artificial Sequence
  synthetic
IGWNSNTI

SEQ ID NO: 1583 - DNA, 48 bp, Artificial Sequence; identical to SEQ ID NO: 1559
  synthetic

SEQ ID NO: 1584 - protein, 16 aa, Artificial Sequence
  synthetic
VKDKSGYGKFFIGLDV

SEQ ID NO: 1585 - DNA, 369 bp, Artificial Sequence
  synthetic
caggtgcagctggtggagtctgggggaggcttggtacagcctggcaggtccctgagactctcctgtgcagcctctggattcacctttgatgattataccatgcactgggtccggcaaggtccagggaagggcctggagtgggtctcagatattggttggaatagtaatactataggctatgcggactctgtgaagggccgattcaccatctccagagacaacgccaggaactccctgtatctgcaaatgaacagtctgcgacctgaagacacggccttatattactgtgtaaaggataaaagtggctacgggaaattccaatacggtttggacgtctggggccaagggaccacggtcaccgtctcctca

SEQ ID NO: 1586 - protein, 123 aa, Artificial Sequence
  synthetic
QVQLVESGGGLVQPGRSLRLSCAASGFTFDDYTMHWVRQGPGKGLEWVSDIGWNSNTIGYADSVKGRFTISRDNARNSLYLQMNSLRPEDTALYYCVKDKSGYGKFQYGLDVWGQGTTVTVSS

SEQ ID NO: 1587 - DNA, 24 bp, Artificial Sequence
  synthetic
ggattcacctttgatgattatacc

SEQ ID NO: 1588 - protein, 8 aa, Artificial Sequence
  synthetic
GFTFDDYT

SEQ ID NO: 1589 - DNA, 24 bp, Artificial Sequence
  synthetic
attggttggaatagtaatactata

SEQ ID NO: 1590 - protein, 8 aa, Artificial Sequence
  synthetic
IGWNSNTI

SEQ ID NO: 1591 - DNA, 48 bp, Artificial Sequence; identical to SEQ ID NO: 1551
  synthetic

SEQ ID NO: 1592 - protein, 16 aa, Artificial Sequence
  synthetic
VKDKSGYGKFQYGLDV

SEQ ID NO: 1593 - DNA, 369 bp, Artificial Sequence
  synthetic
caggtgcaactggtggagtctgggggaggcttggtacagcctggcaggtccctgagactctcctgtgcagcctctggattcaagtttgatgattataccatgcactgggtccggcaaggtccagggaagggcctggagtgggtctcagacattagttggagtggtggtagcatagactatacggactctgtgaagggccgattctccatctccagagacaacgccaagaactccctgtatctgcaaatgaacagtctgagagttgaagacacggccttgtattattgtgtaaaagataaaagtggctacgggaagtactcttacggtttggacgtctggggccaagggaccacggtcaccgtctcctca

SEQ ID NO: 1594 - protein, 123 aa, Artificial Sequence
  synthetic
QVQLVESGGGLVQPGRSLRLSCAASGFKFDDYTMHWVRQGPGKGLEWVSDISWSGGSIDYTDSVKGRFSISRDNAKNSLYLQMNSLRVEDTALYYCVKDKSGYGKYSYGLDVWGQGTTVTVSS

SEQ ID NO: 1595 - DNA, 24 bp, Artificial Sequence
  synthetic
ggattcaagtttgatgattatacc

SEQ ID NO: 1596 - protein, 8 aa, Artificial Sequence
  synthetic
GFKFDDYT

SEQ ID NO: 1597 - DNA, 24 bp, Artificial Sequence
  synthetic
attagttggagtggtggtagcata

SEQ ID NO: 1598 - protein, 8 aa, Artificial Sequence
  synthetic
ISWSGGSI

SEQ ID NO: 1599 - DNA, 48 bp, Artificial Sequence
  synthetic
gtaaaagataaaagtggctacgggaagtactcttacggtttggacgtc

SEQ ID NO: 1600 - protein, 16 aa, Artificial Sequence
  synthetic
VKDKSGYGKYSYGLDV

SEQ ID NO: 1601 - DNA, 357 bp, Artificial Sequence
  synthetic
gaggtgcagctggtggagtctgggggaggcttggtaaagccgggggggtcccttagaatctcctgtgcagcctctggattctctttcattaacgcctggatgaactgggtccgccaggctccagggaaggggctggagtgggttggccgtattaaaagcataagtgatggtgggacaacagactacgctgcatccgtgaaaggcagattcaccatctcaagagaagattcaaaaaatatgctgtttctggaaatgaatagtctgaaaaccgaggacacagccgtgttttactgtaccacagaggtcgctagaactccgaactactggggccggggaaccctggtcaccgtctcctca

SEQ ID NO: 1602 - protein, 119 aa, Artificial Sequence
  synthetic
EVQLVESGGGLVKPGGSLRISCAASGFSFINAWMNWVRQAPGKGLEWVGRIKSISDGGTTDYAASVKGRFTISREDSKNMLFLEMNSLKTEDTAVFYCTTEVARTPNYWGRGTLVTVSS

SEQ ID NO: 1603 - DNA, 24 bp, Artificial Sequence
  synthetic
ggattctctttcattaacgcctgg

SEQ ID NO: 1604 - protein, 8 aa, Artificial Sequence
  synthetic
GFSFINAW

SEQ ID NO: 1605 - DNA, 30 bp, Artificial Sequence
  synthetic
attaaaagcataagtgatggtgggacaaca

SEQ ID NO: 1606 - protein, 10 aa, Artificial Sequence
  synthetic
IKSISDGGTT

SEQ ID NO: 1607 - DNA, 30 bp, Artificial Sequence
  synthetic
accacagaggtcgctagaactccgaactac

SEQ ID NO: 1608 - protein, 10 aa, Artificial Sequence
  synthetic
TTEVARTPNY

SEQ ID NO: 1609 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttatcattatggactggacgtgtggggacaagggacaacagtgacagtgagtagc

SEQ ID NO: 1610 - protein, 124 aa, Artificial Sequence
  synthetic
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKYGSGYGKFYHYGLDVWGQGTTVTVSS

SEQ ID NO: 1611 - DNA, 24 bp, Artificial Sequence
  synthetic
gggtttacattcgacgattacagc

SEQ ID NO: 1612 - protein, 8 aa, Artificial Sequence
  synthetic
GFTFDDYS

SEQ ID NO: 1613 - DNA, 24 bp, Artificial Sequence
  synthetic
atatcatggaactcaggaagcaag

SEQ ID NO: 1614 - protein, 8 aa, Artificial Sequence
  synthetic
ISWNSGSK

SEQ ID NO: 1615 - DNA, 51 bp, Artificial Sequence
  synthetic
gcaaaatacggcagtggttatggcaagttttatcattatggactggacgtg

SEQ ID NO: 1616 - protein, 17 aa, Artificial Sequence
  synthetic
AKYGSGYGKFYHYGLDV

SEQ ID NO: 1617 - DNA, 372 bp, Artificial Sequence
  synthetic
gaagtacaactggtcgaatctggaggaggtcttgttcaacctggtcgatcacttcgcctttcttgtgccgcttctggtttcactttcgacgattatagcatgcattgggtacgacaggctcccggaaaagggctggaatgggtgtcaggaattagttggaactcaggaagtattggatacgctgattcagtcaaaggacgcttcacaatctcaagggacaacgctaaaaactcactttatttgcaaatgaactctctccgcgctgaagataccgctctctattattgcgccaaagatgggtctggttacggttatttttactactatggaatggacgtttggggccaaggaacaactgtcacagtatcatcc

SEQ ID NO: 1618 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKDGSGYGYFYYYGMDVWGQGTTVTVSS

SEQ ID NO: 1619 - DNA, 24 bp, Artificial Sequence
  synthetic
ggtttcactttcgacgattatagc

SEQ ID NO: 1620 - protein, 8 aa, Artificial Sequence
  synthetic
GFTFDDYS

SEQ ID NO: 1621 - DNA, 24 bp, Artificial Sequence
  synthetic
attagttggaactcaggaagtatt

SEQ ID NO: 1622 - protein, 8 aa, Artificial Sequence
  synthetic
ISWNSGSI

SEQ ID NO: 1623 - DNA, 51 bp, Artificial Sequence
  synthetic
gccaaagatgggtctggttacggttatttttactactatggaatggacgtt

SEQ ID NO: 1624 - protein, 17 aa, Artificial Sequence
  synthetic
AKDGSGYGYFYYYGMDV

SEQ ID NO: 1625 - DNA, 372 bp, Artificial Sequence
  synthetic
gaagtgcaactcgttgaaagcggaggaggactggtccagcccggcagatctctcagattgtcttgcgctgcatccggatttacatttgacgactattcaatgcactgggtacggcaagccccaggtaaaggactcgaatgggtaagcggcatatcttggaactcaggcagtattggctacgcagattcagtaaaaggaagattcactatttcaagggataatgctaagaacagtctctacttgcaaatgaatagcttgcgcgcagaagatacagcactttattattgtgcaaaagatggaagcggttatgggaaattttattattatggtatggatgtatggggtcaaggtacaacagttactgtgtcaagt

SEQ ID NO: 1626 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKDGSGYGKFYYYGMDVWGQGTTVTVSS

SEQ ID NO: 1627 - DNA, 24 bp, Artificial Sequence
  synthetic
ggatttacatttgacgactattca

SEQ ID NO: 1628 - protein, 8 aa, Artificial Sequence
  synthetic
GFTFDDYS

SEQ ID NO: 1629 - DNA, 24 bp, Artificial Sequence
  synthetic
atatcttggaactcaggcagtatt

SEQ ID NO: 1630 - protein, 8 aa, Artificial Sequence
  synthetic
ISWNSGSI

SEQ ID NO: 1631 - DNA, 51 bp, Artificial Sequence
  synthetic
gcaaaagatggaagcggttatgggaaattttattattatggtatggatgta

SEQ ID NO: 1632 - protein, 17 aa, Artificial Sequence
  synthetic
AKDGSGYGKFYYYGMDV

SEQ ID NO: 1633 - DNA, 324 bp, Artificial Sequence; identical to SEQ ID NO: 57
  synthetic

SEQ ID NO: 1634 - protein, 108 aa, Artificial Sequence; identical to SEQ ID NO: 58
  synthetic

SEQ ID NO: 1635 - DNA, 18 bp, Artificial Sequence
  synthetic
cagagcattagcagctat

SEQ ID NO: 1636 - protein, 6 aa, Artificial Sequence
  synthetic
QSISSY

SEQ ID NO: 1637 - DNA, 9 bp, Artificial Sequence
  synthetic
gctgcatcc

SEQ ID NO: 1638 - protein, 3 aa, Artificial Sequence
  synthetic
AAS

SEQ ID NO: 1639 - DNA, 30 bp, Artificial Sequence; identical to SEQ ID NO: 15
  synthetic

SEQ ID NO: 1640 - protein, 10 aa, Artificial Sequence
  synthetic
QQSYSTPPIT

SEQ ID NO: 1641 - DNA, 369 bp, Artificial Sequence; identical to SEQ ID NO: 513
  synthetic

SEQ ID NO: 1642 - protein, 123 aa, Artificial Sequence; identical to SEQ ID NO: 514
  synthetic

SEQ ID NO: 1643 - DNA, 24 bp, Artificial Sequence
  synthetic
ggattcacctttgatgattatacc

SEQ ID NO: 1644 - protein, 8 aa, Artificial Sequence
  synthetic
GFTFDDYT

SEQ ID NO: 1645 - DNA, 24 bp, Artificial Sequence
  synthetic
attagttggaatagtggtagtata

SEQ ID NO: 1646 - protein, 8 aa, Artificial Sequence
  synthetic
ISWNSGSI

SEQ ID NO: 1647 - DNA, 48 bp, Artificial Sequence; identical to SEQ ID NO: 519
  synthetic

SEQ ID NO: 1648 - protein, 16 aa, Artificial Sequence
  synthetic
AKDNSGYGHYYYGMDV

SEQ ID NO: 1649 - DNA, 320 bp, Artificial Sequence
  synthetic
gaaatagtgatgacgcagtctccagccaccctgtctgtgtctccaggggaaagagccaccctctcctgcagggccagtcagagtgttagcagcaacttagcctggtaccagcaaaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcactatattaactggcctctcactttcggcggagggaccaaggtggagatcaa

SEQ ID NO: 1650 - protein, 108 aa, Artificial Sequence
  synthetic
AEIVMTQSPATLSVSPGERATLSCRASQSVSSNLAWYQQKPGQAPRLLIYGASTRATGIPARFSGSGSGTEFTLTISSLQSEDFAVYYCQHYINWPLTFGGGTKVEIK

SEQ ID NO: 1651 - DNA, 18 bp, Artificial Sequence
  synthetic
cagagtgttagcagcaac

SEQ ID NO: 1652 - protein, 6 aa, Artificial Sequence
  synthetic
QSVSSN

SEQ ID NO: 1653 - DNA, 9 bp, Artificial Sequence
  synthetic
ggtgcatcc

SEQ ID NO: 1654 - protein, 3 aa, Artificial Sequence
  synthetic
GAS

SEQ ID NO: 1655 - DNA, 27 bp, Artificial Sequence
  synthetic
cagcactatattaactggcctctcact

SEQ ID NO: 1656 - protein, 9 aa, Artificial Sequence
  synthetic
QHYINWPLT

SEQ ID NO: 1657 - DNA, 369 bp, Artificial Sequence; identical to SEQ ID NO: 401
  synthetic

SEQ ID NO: 1658 - protein, 123 aa, Artificial Sequence; identical to SEQ ID NO: 402
  synthetic

SEQ ID NO: 1659 - DNA, 24 bp, Artificial Sequence
  synthetic
ggattcacctttgatgattttacc

SEQ ID NO: 1660 - protein, 8 aa, Artificial Sequence
  synthetic
GFTFDDFT

SEQ ID NO: 1661 - DNA, 24 bp, Artificial Sequence
  synthetic
atcagttggaatagtggtagcata

SEQ ID NO: 1662 - protein, 8 aa, Artificial Sequence
  synthetic
ISWNSGSI

SEQ ID NO: 1663 - DNA, 48 bp, Artificial Sequence; identical to SEQ ID NO: 407
  synthetic

SEQ ID NO: 1664 - protein, 16 aa, Artificial Sequence
  synthetic
AKDNSGYGYYYYGMDV

SEQ ID NO: 1665 - DNA, 321 bp, Artificial Sequence; identical to SEQ ID NO: 409
  synthetic

SEQ ID NO: 1666 - protein, 107 aa, Artificial Sequence; identical to SEQ ID NO: 410
  synthetic

SEQ ID NO: 1667 - DNA, 18 bp, Artificial Sequence
  synthetic
cacagtgttagcaggaac

SEQ ID NO: 1668 - protein, 6 aa, Artificial Sequence
  synthetic
HSVSRN

SEQ ID NO: 1669 - DNA, 9 bp, Artificial Sequence
  synthetic
ggtgcatcc

SEQ ID NO: 1670 - protein, 3 aa, Artificial Sequence
  synthetic
GAS

SEQ ID NO: 1671 - DNA, 27 bp, Artificial Sequence
  synthetic
cagcagtataataattggcctctcact

SEQ ID NO: 1672 - protein, 9 aa, Artificial Sequence
  synthetic
QQYNNWPLT

SEQ ID NO: 1673 - DNA, 369 bp, Artificial Sequence; identical to SEQ ID NO: 513
  synthetic

SEQ ID NO: 1674 - protein, 123 aa, Artificial Sequence; identical to SEQ ID NO: 514
  synthetic

SEQ ID NO: 1675 - DNA, 24 bp, Artificial Sequence
  synthetic
ggattcacctttgatgattatacc

SEQ ID NO: 1676 - protein, 8 aa, Artificial Sequence
  synthetic
GFTFDDYT

SEQ ID NO: 1677 - DNA, 24 bp, Artificial Sequence
  synthetic
attagttggaatagtggtagtata

SEQ ID NO: 1678 - protein, 8 aa, Artificial Sequence
  synthetic
ISWNSGSI

SEQ ID NO: 1679 - DNA, 48 bp, Artificial Sequence; identical to SEQ ID NO: 519
  synthetic

SEQ ID NO: 1680 - protein, 16 aa, Artificial Sequence
  synthetic
AKDNSGYGHYYYGMDV

SEQ ID NO: 1681 - DNA, 321 bp, Artificial Sequence; identical to SEQ ID NO: 521
  synthetic

SEQ ID NO: 1682 - protein, 107 aa, Artificial Sequence; identical to SEQ ID NO: 522
  synthetic

SEQ ID NO: 1683 - DNA, 18 bp, Artificial Sequence
  synthetic
cagagtgttagcagcaac

SEQ ID NO: 1684 - protein, 6 aa, Artificial Sequence
  synthetic
QSVSSN

SEQ ID NO: 1685 - DNA, 9 bp, Artificial Sequence
  synthetic
ggtgcatcc

SEQ ID NO: 1686 - protein, 3 aa, Artificial Sequence
  synthetic
GAS

SEQ ID NO: 1687 - DNA, 27 bp, Artificial Sequence
  synthetic
cagcactatattaactggcctctcact

SEQ ID NO: 1688 - protein, 9 aa, Artificial Sequence
  synthetic
QHYINWPLT

SEQ ID NO: 1689 - DNA, 354 bp, Artificial Sequence; identical to SEQ ID NO: 577
  synthetic

SEQ ID NO: 1690 - protein, 118 aa, Artificial Sequence; identical to SEQ ID NO: 578
  synthetic

SEQ ID NO: 1691 - DNA, 24 bp, Artificial Sequence
  synthetic
ggatttaccttcagaagttatgcc

SEQ ID NO: 1692 - protein, 8 aa, Artificial Sequence
  synthetic
GFTFRSYA

SEQ ID NO: 1693 - DNA, 24 bp, Artificial Sequence
  synthetic
gtatactatgatggaaataatcaa

SEQ ID NO: 1694 - protein, 8 aa, Artificial Sequence
  synthetic
VYYDGNNQ

SEQ ID NO: 1695 - DNA, 33 bp, Artificial Sequence; identical to SEQ ID NO: 551
  synthetic

SEQ ID NO: 1696 - protein, 11 aa, Artificial Sequence
  synthetic
ARGPGYNWLDP

SEQ ID NO: 1697 - DNA, 321 bp, Artificial Sequence; identical to SEQ ID NO: 585
  synthetic

SEQ ID NO: 1698 - protein, 107 aa, Artificial Sequence; identical to SEQ ID NO: 586
  synthetic

SEQ ID NO: 1699 - DNA, 18 bp, Artificial Sequence
  synthetic
cagagtgttagcaggaac

SEQ ID NO: 1700 - protein, 6 aa, Artificial Sequence
  synthetic
QSVSRN

SEQ ID NO: 1701 - DNA, 9 bp, Artificial Sequence
  synthetic
ggtgcatcc

SEQ ID NO: 1702 - protein, 3 aa, Artificial Sequence
  synthetic
GAS

SEQ ID NO: 1703 - DNA, 27 bp, Artificial Sequence
  synthetic
cagcagtataataactggcctctcact

SEQ ID NO: 1704 - protein, 9 aa, Artificial Sequence
  synthetic
QQYNNWPLT

SEQ ID NO: 1705 - DNA, 354 bp, Artificial Sequence; identical to SEQ ID NO: 561
  synthetic

SEQ ID NO: 1706 - protein, 118 aa, Artificial Sequence; identical to SEQ ID NO: 562
  synthetic

SEQ ID NO: 1707 - DNA, 24 bp, Artificial Sequence
  synthetic
ggattcaccttcagaagttatggc

SEQ ID NO: 1708 - protein, 8 aa, Artificial Sequence
  synthetic
GFTFRSYG

SEQ ID NO: 1709 - DNA, 24 bp, Artificial Sequence
  synthetic
atttactatgatggtaagaataaa

SEQ ID NO: 1710 - protein, 8 aa, Artificial Sequence
  synthetic
IYYDGKNK

SEQ ID NO: 1711 - DNA, 33 bp, Artificial Sequence; identical to SEQ ID NO: 567
  synthetic

SEQ ID NO: 1712 - protein, 11 aa, Artificial Sequence
  synthetic
ARGPGYNWLDP

SEQ ID NO: 1713 - DNA, 321 bp, Artificial Sequence; identical to SEQ ID NO: 569
  synthetic

SEQ ID NO: 1714 - protein, 107 aa, Artificial Sequence; identical to SEQ ID NO: 570
  synthetic

SEQ ID NO: 1715 - DNA, 18 bp, Artificial Sequence
  synthetic
cagagaattagcagcaac

SEQ ID NO: 1716 - protein, 6 aa, Artificial Sequence
  synthetic
QRISSN

SEQ ID NO: 1717 - DNA, 9 bp, Artificial Sequence
  synthetic
ggtgcatcc

SEQ ID NO: 1718 - protein, 3 aa, Artificial Sequence
  synthetic
GAS

SEQ ID NO: 1719 - DNA, 27 bp, Artificial Sequence
  synthetic
cagcaacatcataactggcctctcact

SEQ ID NO: 1720 - protein, 9 aa, Artificial Sequence
  synthetic
QQHHNWPLT

SEQ ID NO: 1721 - protein, 119 aa, Artificial Sequence
  synthetic
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 1722 - protein, 8 aa, Artificial Sequence
  synthetic
GYTFTRYT

SEQ ID NO: 1723 - protein, 8 aa, Artificial Sequence
  synthetic
INPSRGYT

SEQ ID NO: 1724 - protein, 12 aa, Artificial Sequence
  synthetic
ARYYDDHYCLDY

SEQ ID NO: 1725 - protein, 106 aa, Artificial Sequence
  synthetic
DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 1726 - protein, 11 aa, Artificial Sequence
  synthetic
LSCRASQSVSY

SEQ ID NO: 1727 - protein, 3 aa, Artificial Sequence
  synthetic
DTS

SEQ ID NO: 1728 - protein, 9 aa, Artificial Sequence
  synthetic
QQWSSNPLT

SEQ ID NO: 1729 - DNA, 372 bp, Artificial Sequence; identical to SEQ ID NO: 1609
  synthetic

SEQ ID NO: 1730 - protein, 124 aa, Artificial Sequence; identical to SEQ ID NO: 1610
  synthetic

SEQ ID NO: 1731 - DNA, 24 bp, Artificial Sequence
  synthetic
gggtttacattcgacgattacagc

SEQ ID NO: 1732 - protein, 8 aa, Artificial Sequence
  synthetic
GFTFDDYS

SEQ ID NO: 1733 - DNA, 24 bp, Artificial Sequence
  synthetic
atatcatggaactcaggaagcaag

SEQ ID NO: 1734 - protein, 8 aa, Artificial Sequence
  synthetic
ISWNSGSK

SEQ ID NO: 1735 - DNA, 51 bp, Artificial Sequence; identical to SEQ ID NO: 1615
  synthetic

SEQ ID NO: 1736 - protein, 17 aa, Artificial Sequence
  synthetic
AKYGSGYGKFYHYGLDV

SEQ ID NO: 1737 - DNA, 372 bp, Artificial Sequence
  synthetic
gaagtacagttggtagaatctggaggaggactcgtgcaaccaggacgatcattgcggttgagttgtgctgctagtggattcacattcgacgactatgctatgcattgggtaagacaggctccaggaaaaggactcgaatgggtgtcaggaataagttggaactccggaagcattgggtacgcagattcagtcaaagggcgattcaccatatcccgagataacgctaagaactcactttaccttcaaatgaactctcttcgagcagaggacactgcactttattattgcgctaaggacggctccggttatggatatttttattattatggaatggacgtatggggacaaggcactactgttaccgttagttcc

SEQ ID NO: 1738 - protein, 124 aa, Artificial Sequence
  synthetic
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDGSGYGYFYYYGMDVWGQGTTVTVSS

SEQ ID NO: 1739 - DNA, 24 bp, Artificial Sequence
  synthetic
ggattcacattcgacgactatgct

SEQ ID NO: 1740 - protein, 8 aa, Artificial Sequence
  synthetic
GFTFDDYA

SEQ ID NO: 1741 - DNA, 24 bp, Artificial Sequence
  synthetic
ataagttggaactccggaagcatt

SEQ ID NO: 1742 - protein, 8 aa, Artificial Sequence
  synthetic
ISWNSGSI

SEQ ID NO: 1743 - DNA, 51 bp, Artificial Sequence
  synthetic
gctaaggacggctccggttatggatatttttattattatggaatggacgta

SEQ ID NO: 1744 - protein, 17 aa, Artificial Sequence
  synthetic
AKDGSGYGYFYYYGMDV

SEQ ID NO: 1745 - DNA, 372 bp, Artificial Sequence; identical to SEQ ID NO: 1617
  synthetic

SEQ ID NO: 1746 - protein, 124 aa, Artificial Sequence; identical to SEQ ID NO: 1618
  synthetic

SEQ ID NO: 1747 - DNA, 24 bp, Artificial Sequence
  synthetic
ggtttcactttcgacgattatagc

SEQ ID NO: 1748 - protein, 8 aa, Artificial Sequence
  synthetic
GFTFDDYS

SEQ ID NO: 1749 - DNA, 24 bp, Artificial Sequence
  synthetic
attagttggaactcaggaagtatt

SEQ ID NO: 1750 - protein, 8 aa, Artificial Sequence
  synthetic
ISWNSGSI

SEQ ID NO: 1751 - DNA, 51 bp, Artificial Sequence; identical to SEQ ID NO: 1623
  synthetic

SEQ ID NO: 1752 - protein, 17 aa, Artificial Sequence
  synthetic
AKDGSGYGYFYYYGMDV

SEQ ID NO: 1753 - DNA, 372 bp, Artificial Sequence
  synthetic
gaagttcaacttgtggaaagtggcggaggattggttcaaccaggacgttcattgaggctttcatgcgcagcttccggatttacatttgacgattacgcaatgcactgggttagacaggcaccaggaaaaggactggagtgggtgagcgggatttcatggaacagcggcagtatcggttatgcagactcagttaaaggaagattcaccatcagtagagacaacgcaaaaaattccctttatctccaaatgaactctcttagggccgaagatacagcattgtactactgcgcaaaagacggatcaggttacggaaaattttactactatggtatggatgtatggggtcagggaaccacagtaactgtatcaagc

SEQ ID NO: 1754 - protein, 124 aa, Artificial Sequence
  synthetic
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDGSGYGKFYYYGMDVWGQGTTVTVSS

SEQ ID NO: 1755 - DNA, 24 bp, Artificial Sequence
  synthetic
ggatttacatttgacgattacgca

SEQ ID NO: 1756 - protein, 8 aa, Artificial Sequence
  synthetic
GFTFDDYA

SEQ ID NO: 1757 - DNA, 24 bp, Artificial Sequence
  synthetic
atttcatggaacagcggcagtatc

SEQ ID NO: 1758 - protein, 8 aa, Artificial Sequence
  synthetic
ISWNSGSI

SEQ ID NO: 1759 - DNA, 51 bp, Artificial Sequence
  synthetic
gcaaaagacggatcaggttacggaaaattttactactatggtatggatgta

SEQ ID NO: 1760 - protein, 17 aa, Artificial Sequence
  synthetic
AKDGSGYGKFYYYGMDV

SEQ ID NO: 1761 - DNA, 372 bp, Artificial Sequence; identical to SEQ ID NO: 1625
  synthetic

SEQ ID NO: 1762 - protein, 124 aa, Artificial Sequence; identical to SEQ ID NO: 1626
  synthetic

SEQ ID NO: 1763 - DNA, 24 bp, Artificial Sequence
  synthetic
ggatttacatttgacgactattca

SEQ ID NO: 1764 - protein, 8 aa, Artificial Sequence
  synthetic
GFTFDDYS

SEQ ID NO: 1765 - DNA, 24 bp, Artificial Sequence
  synthetic
atatcttggaactcaggcagtatt

SEQ ID NO: 1766 - protein, 8 aa, Artificial Sequence
  synthetic
ISWNSGSI

SEQ ID NO: 1767 - DNA, 51 bp, Artificial Sequence; identical to SEQ ID NO: 1631
  synthetic

SEQ ID NO: 1768 - protein, 17 aa, Artificial Sequence
  synthetic
AKDGSGYGKFYYYGMDV

SEQ ID NO: 1769 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttatcattatggactggacgtgtggggacaagggacaacagtgacagtgagtagc

SEQ ID NO: 1770 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKYGSGYGKFYHYGLDVWGQGTTVTVSS

SEQ ID NO: 1771 - DNA, 24 bp, Artificial Sequence
  synthetic
gggtttacattcgacgattacagc

SEQ ID NO: 1772 - protein, 8 aa, Artificial Sequence
  synthetic
GFTFDDYS

SEQ ID NO: 1773 - DNA, 24 bp, Artificial Sequence
  synthetic
atatcatggaactcaggaagcatc

SEQ ID NO: 1774 - protein, 8 aa, Artificial Sequence
  synthetic
ISWNSGSI

SEQ ID NO: 1775 - DNA, 51 bp, Artificial Sequence; identical to SEQ ID NO: 1615
  synthetic

SEQ ID NO: 1776 - protein, 17 aa, Artificial Sequence
  synthetic
AKYGSGYGKFYHYGLDV

SEQ ID NO: 1777 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttatcattatggactggacgtgtggggacaagggacaacagtgacagtgagtagc

SEQ ID NO: 1778 - protein, 124 aa, Artificial Sequence
  synthetic
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKDGSGYGKFYHYGLDVWGQGTTVTVSS

SEQ ID NO: 1779 - DNA, 24 bp, Artificial Sequence
  synthetic
gggtttacattcgacgattacagc

SEQ ID NO: 1780 - protein, 8 aa, Artificial Sequence
  synthetic
GFTFDDYS

SEQ ID NO: 1781 - DNA, 24 bp, Artificial Sequence
  synthetic
atatcatggaactcaggaagcaag

SEQ ID NO: 1782 - protein, 8 aa, Artificial Sequence
  synthetic
ISWNSGSK

SEQ ID NO: 1783 - DNA, 51 bp, Artificial Sequence
  synthetic
gcaaaagacggcagtggttatggcaagttttatcattatggactggacgtg

SEQ ID NO: 1784 - protein, 17 aa, Artificial Sequence
  synthetic
AKDGSGYGKFYHYGLDV

SEQ ID NO: 1785 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttattattatggactggacgtgtggggacaagggacaacagtgacagtgagtagc

SEQ ID NO: 1786 - protein, 124 aa, Artificial Sequence
  synthetic
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKYGSGYGKFYYYGLDVWGQGTTVTVSS

SEQ ID NO: 1787 - DNA, 24 bp, Artificial Sequence
  synthetic
gggtttacattcgacgattacagc

SEQ ID NO: 1788 - protein, 8 aa, Artificial Sequence
  synthetic
GFTFDDYS

SEQ ID NO: 1789 - DNA, 24 bp, Artificial Sequence
  synthetic
atatcatggaactcaggaagcaag

SEQ ID NO: 1790 - protein, 8 aa, Artificial Sequence
  synthetic
ISWNSGSK

SEQ ID NO: 1791 - DNA, 51 bp, Artificial Sequence
  synthetic
gcaaaatacggcagtggttatggcaagttttattattatggactggacgtg

SEQ ID NO: 1792 - protein, 17 aa, Artificial Sequence
  synthetic
AKYGSGYGKFYYYGLDV

SEQ ID NO: 1793 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttatcattatggaatggacgtgtggggacaagggacaacagtgacagtgagtagc

SEQ ID NO: 1794 - protein, 124 aa, Artificial Sequence
  synthetic
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKYGSGYGKFYHYGMDVWGQGTTVTVSS

SEQ ID NO: 1795 - DNA, 24 bp, Artificial Sequence
  synthetic
gggtttacattcgacgattacagc

SEQ ID NO: 1796 - protein, 8 aa, Artificial Sequence
  synthetic
GFTFDDYS

SEQ ID NO: 1797 - DNA, 24 bp, Artificial Sequence
  synthetic
atatcatggaactcaggaagcaag

SEQ ID NO: 1798 - protein, 8 aa, Artificial Sequence
  synthetic
ISWNSGSK

SEQ ID NO: 1799 - DNA, 51 bp, Artificial Sequence
  synthetic
gcaaaatacggcagtggttatggcaagttttatcattatggaatggacgtg

SEQ ID NO: 1800 - protein, 17 aa, Artificial Sequence
  synthetic
AKYGSGYGKFYHYGMDV

SEQ ID NO: 1801 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttatcattatggactggacgtgtggggacaagggacaacagtgacagtgagtagc

SEQ ID NO: 1802 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKDGSGYGKFYHYGLDVWGQGTTVTVSS

SEQ ID NO: 1803 - DNA, 24 bp, Artificial Sequence
  synthetic
gggtttacattcgacgattacagc

SEQ ID NO: 1804 - protein, 8 aa, Artificial Sequence
  synthetic
GFTFDDYS

SEQ ID NO: 1805 - DNA, 24 bp, Artificial Sequence
  synthetic
atatcatggaactcaggaagcatc

SEQ ID NO: 1806 - protein, 8 aa, Artificial Sequence
  synthetic
ISWNSGSI

SEQ ID NO: 1807 - DNA, 51 bp, Artificial Sequence; identical to SEQ ID NO: 1783
  synthetic

SEQ ID NO: 1808 - protein, 17 aa, Artificial Sequence
  synthetic
AKDGSGYGKFYHYGLDV

SEQ ID NO: 1809 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttattattatggactggacgtgtggggacaagggacaacagtgacagtgagtagc

SEQ ID NO: 1810 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKYGSGYGKFYYYGLDVWGQGTTVTVSS

SEQ ID NO: 1811 - DNA, 24 bp, Artificial Sequence
  synthetic
gggtttacattcgacgattacagc

SEQ ID NO: 1812 - protein, 8 aa, Artificial Sequence
  synthetic
GFTFDDYS

SEQ ID NO: 1813 - DNA, 24 bp, Artificial Sequence
  synthetic
atatcatggaactcaggaagcatc

SEQ ID NO: 1814 - protein, 8 aa, Artificial Sequence
  synthetic
ISWNSGSI

SEQ ID NO: 1815 - DNA, 51 bp, Artificial Sequence; identical to SEQ ID NO: 1791
  synthetic

SEQ ID NO: 1816 - protein, 17 aa, Artificial Sequence
  synthetic
AKYGSGYGKFYYYGLDV

SEQ ID NO: 1817 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttatcattatggaatggacgtgtggggacaagggacaacagtgacagtgagtagc

SEQ ID NO: 1818 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKYGSGYGKFYHYGMDVWGQGTTVTVSS

SEQ ID NO: 1819 - DNA, 24 bp, Artificial Sequence
  synthetic
gggtttacattcgacgattacagc

SEQ ID NO: 1820 - protein, 8 aa, Artificial Sequence
  synthetic
GFTFDDYS

SEQ ID NO: 1821 - DNA, 24 bp, Artificial Sequence
  synthetic
atatcatggaactcaggaagcatc

SEQ ID NO: 1822 - protein, 8 aa, Artificial Sequence
  synthetic
ISWNSGSI

SEQ ID NO: 1823 - DNA, 51 bp, Artificial Sequence; identical to SEQ ID NO: 1799
  synthetic

SEQ ID NO: 1824 - protein, 17 aa, Artificial Sequence
  synthetic
AKYGSGYGKFYHYGMDV

SEQ ID NO: 1825 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttattattatggactggacgtgtggggacaagggacaacagtgacagtgagtagc

SEQ ID NO: 1826 - protein, 124 aa, Artificial Sequence
  synthetic
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKDGSGYGKFYYYGLDVWGQGTTVTVSS

SEQ ID NO: 1827 - DNA, 24 bp, Artificial Sequence
  synthetic
gggtttacattcgacgattacagc

SEQ ID NO: 1828 - protein, 8 aa, Artificial Sequence
  synthetic
GFTFDDYS

SEQ ID NO: 1829 - DNA, 24 bp, Artificial Sequence
  synthetic
atatcatggaactcaggaagcaag

SEQ ID NO: 1830 - protein, 8 aa, Artificial Sequence
  synthetic
ISWNSGSK

SEQ ID NO: 1831 - DNA, 51 bp, Artificial Sequence
  synthetic
gcaaaagacggcagtggttatggcaagttttattattatggactggacgtg

SEQ ID NO: 1832 - protein, 17 aa, Artificial Sequence
  synthetic
AKDGSGYGKFYYYGLDV

SEQ ID NO: 1833 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttatcattatggaatggacgtgtggggacaagggacaacagtgacagtgagtagc

SEQ ID NO: 1834 - protein, 124 aa, Artificial Sequence
  synthetic
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKDGSGYGKFYHYGMDVWGQGTTVTVSS

SEQ ID NO: 1835 - DNA, 24 bp, Artificial Sequence
  synthetic
gggtttacattcgacgattacagc

SEQ ID NO: 1836 - protein, 8 aa, Artificial Sequence
  synthetic
GFTFDDYS

SEQ ID NO: 1837 - DNA, 24 bp, Artificial Sequence
  synthetic
atatcatggaactcaggaagcaag

SEQ ID NO: 1838 - protein, 8 aa, Artificial Sequence
  synthetic
ISWNSGSK

SEQ ID NO: 1839 - DNA, 51 bp, Artificial Sequence
  synthetic
gcaaaagacggcagtggttatggcaagttttatcattatggaatggacgtg

SEQ ID NO: 1840 - protein, 17 aa, Artificial Sequence
  synthetic
AKDGSGYGKFYHYGMDV

SEQ ID NO: 1841 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttattattatggaatggacgtgtggggacaagggacaacagtgacagtgagtagc

SEQ ID NO: 1842 - protein, 124 aa, Artificial Sequence
  synthetic
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKYGSGYGKFYYYGMDVWGQGTTVTVSS

SEQ ID NO: 1843 - DNA, 24 bp, Artificial Sequence
  synthetic
gggtttacattcgacgattacagc

SEQ ID NO: 1844 - protein, 8 aa, Artificial Sequence
  synthetic
GFTFDDYS

SEQ ID NO: 1845 - DNA, 24 bp, Artificial Sequence
  synthetic
atatcatggaactcaggaagcaag

SEQ ID NO: 1846 - protein, 8 aa, Artificial Sequence
  synthetic
ISWNSGSK

SEQ ID NO: 1847 - DNA, 51 bp, Artificial Sequence
  synthetic
gcaaaatacggcagtggttatggcaagttttattattatggaatggacgtg

SEQ ID NO: 1848 - protein, 17 aa, Artificial Sequence
  synthetic
AKYGSGYGKFYYYGMDV

SEQ ID NO: 1849 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttattattatggactggacgtgtggggacaagggacaacagtgacagtgagtagc

SEQ ID NO: 1850 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKDGSGYGKFYYYGLDVWGQGTTVTVSS

SEQ ID NO: 1851 - DNA, 24 bp, Artificial Sequence
  synthetic
gggtttacattcgacgattacagc

SEQ ID NO: 1852 - protein, 8 aa, Artificial Sequence
  synthetic
GFTFDDYS

SEQ ID NO: 1853 - DNA, 24 bp, Artificial Sequence
  synthetic
atatcatggaactcaggaagcatc

SEQ ID NO: 1854 - protein, 8 aa, Artificial Sequence
  synthetic
ISWNSGSI

SEQ ID NO: 1855 - DNA, 51 bp, Artificial Sequence; identical to SEQ ID NO: 1831
  synthetic

SEQ ID NO: 1856 - protein, 17 aa, Artificial Sequence
  synthetic
AKDGSGYGKFYYYGLDV

SEQ ID NO: 1857 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttatcattatggaatggacgtgtggggacaagggacaacagtgacagtgagtagc

SEQ ID NO: 1858 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKDGSGYGKFYHYGMDVWGQGTTVTVSS

SEQ ID NO: 1859 - DNA, 24 bp, Artificial Sequence
  synthetic
gggtttacattcgacgattacagc

SEQ ID NO: 1860 - protein, 8 aa, Artificial Sequence
  synthetic
GFTFDDYS

SEQ ID NO: 1861 - DNA, 24 bp, Artificial Sequence
  synthetic
atatcatggaactcaggaagcatc

SEQ ID NO: 1862 - protein, 8 aa, Artificial Sequence
  synthetic
ISWNSGSI

SEQ ID NO: 1863 - DNA, 51 bp, Artificial Sequence; identical to SEQ ID NO: 1839
  synthetic

SEQ ID NO: 1864 - protein, 17 aa, Artificial Sequence
  synthetic
AKDGSGYGKFYHYGMDV

SEQ ID NO: 1865 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttattattatggaatggacgtgtggggacaagggacaacagtgacagtgagtagc

SEQ ID NO: 1866 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKYGSGYGKFYYYGMDVWGQGTTVTVSS

SEQ ID NO: 1867 - DNA, 24 bp, Artificial Sequence
  synthetic
gggtttacattcgacgattacagc

SEQ ID NO: 1868 - protein, 8 aa, Artificial Sequence
  synthetic
GFTFDDYS

SEQ ID NO: 1869 - DNA, 24 bp, Artificial Sequence
  synthetic
atatcatggaactcaggaagcatc

SEQ ID NO: 1870 - protein, 8 aa, Artificial Sequence
  synthetic
ISWNSGSI

SEQ ID NO: 1871 - DNA, 51 bp, Artificial Sequence; identical to SEQ ID NO: 1847
  synthetic

SEQ ID NO: 1872 - protein, 17 aa, Artificial Sequence
  synthetic
AKYGSGYGKFYYYGMDV

SEQ ID NO: 1873 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttattattatggaatggacgtgtggggacaagggacaacagtgacagtgagtagc

SEQ ID NO: 1874 - protein, 124 aa, Artificial Sequence
  synthetic
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKDGSGYGKFYYYGMDVWGQGTTVTVSS

SEQ ID NO: 1875 - DNA, 24 bp, Artificial Sequence
  synthetic
gggtttacattcgacgattacagc

SEQ ID NO: 1876 - protein, 8 aa, Artificial Sequence
  synthetic
GFTFDDYS

SEQ ID NO: 1877 - DNA, 24 bp, Artificial Sequence
  synthetic
atatcatggaactcaggaagcaag

SEQ ID NO: 1878 - protein, 8 aa, Artificial Sequence
  synthetic
ISWNSGSK

SEQ ID NO: 1879 - DNA, 51 bp, Artificial Sequence
  synthetic
gcaaaagacggcagtggttatggcaagttttattattatggaatggacgtg

SEQ ID NO: 1880 - protein, 17 aa, Artificial Sequence
  synthetic
AKDGSGYGKFYYYGMDV

SEQ ID NO: 1881 - DNA, 372 bp, Artificial Sequence
  synthetic
gaagtgcagctggtggagtctgggggaggcttggtacagcctggcaggtccctgagactctcctgtgtagcctctggattcacctttgatgattattccatgcactgggtccggcaagctccagggaagggcctggagtgggtctcaggtattagttggaatagtggtagcaaagactatgcggactctgtgaagggccgattcaccatctccagagacaacgccaagaactccctgtatctgcaaatgaacagtctgagagctgaagacacggccttgtattactgtgcaaaatatggaagtggctacgggaagttctaccactacggtttggacgtctggggccaagggaccacggtcaccgtctcctca

SEQ ID NO: 1882 - protein, 124 aa, Artificial Sequence; identical to SEQ ID NO: 1506
  synthetic

SEQ ID NO: 1883 - DNA, 24 bp, Artificial Sequence
  synthetic
ggattcacctttgatgattattcc

SEQ ID NO: 1884 - protein, 8 aa, Artificial Sequence
  synthetic
GFTFDDYS

SEQ ID NO: 1885 - DNA, 24 bp, Artificial Sequence
  synthetic
attagttggaatagtggtagcaaa

SEQ ID NO: 1886 - protein, 8 aa, Artificial Sequence
  synthetic
ISWNSGSK

SEQ ID NO: 1887 - DNA, 51 bp, Artificial Sequence; identical to SEQ ID NO: 1511
  synthetic

SEQ ID NO: 1888 - protein, 17 aa, Artificial Sequence
  synthetic
AKYGSGYGKFYHYGLDV

SEQ ID NO: 1889 - DNA, 324 bp, Artificial Sequence
  synthetic
gacatccagatgacccagtctccatcctccctgtctgcatctgttggagacagcgtcaccatcacttgccgggcaagtcagagcattaacaactatttaaattggtatcagcagaaaccagggaaagcccctaagctcctgatctatactgcatccagtttgctaagtggggtcccttcaaggttcagtggcagtggatctgggacagatttcactctcaccatcagcggtctgcaccctgaagattttgcaacttacttctgtcaacagagtttcagtacccctccgatcaccttcggccaagggacacgactggacattaaa

SEQ ID NO: 1890 - protein, 108 aa, Artificial Sequence
  synthetic
DIQMTQSPSSLSASVGDSVTITCRASQSINNYLNWYQQKPGKAPKLLIYTASSLLSGVPSRFSGSGSGTDFTLTISGLHPEDFATYFCQQSFSTPPITFGQGTRLDIK

SEQ ID NO: 1891 - DNA, 18 bp, Artificial Sequence
  synthetic
cagagcattaacaactat

SEQ ID NO: 1892 - protein, 6 aa, Artificial Sequence
  synthetic
QSINNY

SEQ ID NO: 1893 - DNA, 9 bp, Artificial Sequence
  synthetic
actgcatcc

SEQ ID NO: 1894 - protein, 3 aa, Artificial Sequence
  synthetic
TAS

SEQ ID NO: 1895 - DNA, 30 bp, Artificial Sequence
  synthetic
caacagagtttcagtacccctccgatcacc

SEQ ID NO: 1896 - protein, 10 aa, Artificial Sequence
  synthetic
QQSFSTPPIT

SEQ ID NO: 1897 - protein, 207 aa, Artificial Sequence
  synthetic
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 1898 - protein, 171 aa, Artificial Sequence
  synthetic
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 1899 - protein, 490 aa, Homo sapiens
MESISMMGSPKSLSETFLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQSTLGYVALLISTFHVLIYGWKRAFEEEYYRFYTPPNFVLALVLPSIVILGKIILFLPCISRKLKRIKKGWEKSQFLEEGMGGTIPHVSPERVTVM

SEQ ID NO: 1900 - protein, 207 aa, Artificial Sequence; identical to SEQ ID NO: 1897
  synthetic

SEQ ID NO: 1901 - protein, 171 aa, Artificial Sequence; identical to SEQ ID NO: 1898
  synthetic

SEQ ID NO: 1902 - skipped

SEQ ID NO: 1903 - protein, 25 aa, Artificial Sequence [sequence omitted]

SEQ ID NO: 1904 - protein, 17 aa, Artificial Sequence
  synthetic
MHWVRQAPGKGLEWVSG

SEQ ID NO: 1905 - protein, 38 aa, Artificial Sequence
  synthetic
GYADSVKGRFTISRDNAKNSLYLQMNSLRAEDTALYYC

SEQ ID NO: 1906 - protein, 11 aa, Artificial Sequence
  synthetic
WGQGTTVTVSS

SEQ ID NO: 1907 - protein, 8 aa, Artificial Sequence
  synthetic
  VARIANT (8)..(8): Xaa = Any Amino Acid
GFTFDDYX

SEQ ID NO: 1908 - protein, 8 aa, Artificial Sequence
  synthetic
  VARIANT (8)..(8): Xaa = Any Amino Acid
ISWNSGSX

SEQ ID NO: 1909 - protein, 17 aa, Artificial Sequence
  synthetic
  VARIANT (3)..(3): Xaa = Any Amino Acid
  VARIANT (12)..(12): Xaa = Any Amino Acid
  VARIANT (15)..(15): Xaa = Any Amino Acid
AKXGSGYGKFYXYGXDV

SEQ ID NO: 1910 - protein, 125 aa, Artificial Sequence
  synthetic
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDGYSGYGYFYYYGMDVWGQGTTVTVSS

SEQ ID NO: 1911 - protein, 330 aa, Artificial Sequence [sequence omitted]

SEQ ID NO: 1912 - protein, 330 aa, Artificial Sequence
  synthetic
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1913 - protein, 326 aa, Artificial Sequence
  synthetic
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 1914 - protein, 326 aa, Artificial Sequence
  synthetic
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNRFTQKSLSLSPGK

SEQ ID NO: 1915 - protein, 327 aa, Artificial Sequence
  synthetic
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1916 - protein, 327 aa, Artificial Sequence
  synthetic
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNRFTQKSLSLSLGK

SEQ ID NO: 1917 - protein, 329 aa, Artificial Sequence
  synthetic
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1918 - protein, 329 aa, Artificial Sequence
  synthetic
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1919 - protein, 326 aa, Artificial Sequence
  synthetic
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1920 - protein, 326 aa, Artificial Sequence
  synthetic
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNRFTQKSLSLSLGK

SEQ ID NO: 1921 - protein, 232 aa, Artificial Sequence
  synthetic
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1922 - protein, 232 aa, Artificial Sequence
  synthetic
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1923 - protein, 228 aa, Artificial Sequence
  synthetic
ERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 1924 - protein, 228 aa, Artificial Sequence
  synthetic
ERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNRFTQKSLSLSPGK

SEQ ID NO: 1925 - protein, 229 aa, Artificial Sequence
  synthetic
ESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNRFTQKSLSLSLGK

SEQ ID NO: 1926 - protein, 229 aa, Artificial Sequence
  synthetic
ESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1927 - protein, 231 aa, Artificial Sequence
  synthetic
EPKSCDKTHTCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1928 - protein, 231 aa, Artificial Sequence
  synthetic
EPKSCDKTHTCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1929 - protein, 228 aa, Artificial Sequence
  synthetic
ESKYGPPCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1930 - protein, 228 aa, Artificial Sequence
  synthetic
ESKYGPPCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNRFTQKSLSLSLGK

SEQ ID NO: 1931 - protein, 227 aa, Artificial Sequence
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1932 - protein, 227 aa, Artificial Sequence
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1933 - protein, 233 aa, Artificial Sequence
  synthetic
EPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNRFTTKSFSRTPGK

SEQ ID NO: 1934 - protein, 233 aa, Artificial Sequence
  synthetic
EPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

What is claimed is:

1. An antibody-drug conjugate (ADC) comprising an anti-STEAP2 antibody or antigen-binding fragment thereof and a cytotoxic agent, wherein the antibody or antigen-binding fragment and the cytotoxic agent are covalently attached via a linker, and wherein the anti-STEAP2 antibody or antigen-binding fragment comprises: (a) the complementarity determining regions (CDRs) of a heavy chain variable region (HCVR) comprising an amino acid sequence selected from the group consisting of SEQ ID NOs: 2, 18, 34, 50, 66, 74, 82, 90, 98, 106, 122, 138, 154, 170, 186, 202, 218, 234, 250, 266, 282, 298, 314, 330, 346, 362, and 378; and (b) the CDRs of a light chain variable region (LCVR) comprising an amino acid sequence selected from the group consisting of SEQ ID NOs: 10, 26, 42, 58, 114, 130, 146, 162, 178, 194, 210, 226, 242, 258, 274, 290, 306, 322, 338, 354, 370, and 386.

2. The ADC of claim 1, wherein the anti-STEAP2 antibody or antigen-binding fragment thereof is internalized by human STEAP2-expressing cells.

3. The ADC of claim 2, wherein the anti-STEAP2 antibody is fully human.

4. The ADC of claim 1, wherein the anti-STEAP2 antibody or antigen-binding fragment comprises the heavy and light chain CDRs of a HCVR/LCVR amino acid sequence pair selected from the group consisting of: SEQ ID NOs: 2/10; 18/26; 34/42; 50/58; 66/58; 74/58; 82/58; 90/58; 98/58; 106/114; 122/130; 138/146; 154/162; 170/178; 186/194; 202/210; 218/226; 234/242; 250/258; 266/274; 282/290; 298/306; 314/322; 330/338; 346/354; 362/370; and 378/386.

5. The ADC of claim 4, wherein the anti-STEAP2 antibody or antigen-binding fragment comprises HCDR1-HCDR2-HCDR3-LCDR1-LCDR2-LCDR3 domains comprising the amino acid sequences, respectively, selected from the group consisting of: SEQ ID NOs:4-6-8-12-14-16; 20-22-24-28-30-32; 36-38-40-44-46-48; 52-54-56-60-62-64; 68-70-72-60-62-64; 76-78-80-60-62-64; 84-86-88-60-62-64; 92-94-96-60-62-64; 100-102-104-60-62-64; 108-110-112-116-118-120; 124-126-128-132-134-136; 140-142-144-148-150-152; 156-158-160-164-166-168; 172-174-176-180-182-184; 188-190-192-196-198-200; 204-206-208-212-214-216; 220-222-224-228-230-232; 236-238-240-244-246-248; 252-254-256-260-262-264; 268-270-272-276-278-280; 284-286-288-292-294-296; 300-302-304-308-310-312; 316-318-320-324-326-328; 332-334-336-340-342-344; 348-350-352-356-358-360; 364-366-368-372-374-376; and 380-382-384-388-390-392.

6. The ADC of claim 1, wherein the anti-STEAP2 antibody or antigen-binding fragment comprises: (a) a heavy chain variable region (HCVR) comprising an amino acid sequence selected from the group consisting of SEQ ID NOs: 2, 18, 34, 50, 66, 74, 82, 90, 98, 106, 122, 138, 154, 170, 186, 202, 218, 234, 250, 266, 282, 298, 314, 330, 346, 362, and 378; and (b) a light chain variable region (LCVR) comprising an amino acid sequence selected from the group consisting of SEQ ID NOs: 10; 26; 42; 58; 114; 130; 146; 162; 178; 194; 210; 226; 242; 258; 274; 290; 306; 322; 338; 354; 370; and 386.

7. The ADC of claim 6, wherein the anti-STEAP2 antibody or antigen-binding fragment comprises a HCVR/LCVR amino acid sequence pair selected from the group consisting of: SEQ ID NOs: 2/10; 18/26; 34/42; 50/58; 66/58; 74/58; 82/58; 90/58; 98/58; 106/114; 122/130; 138/146; 154/162; 170/178; 186/194; 202/210; 218/226; 234/242; 250/258; 266/274; 282/290; 298/306; 314/322; 330/338; 346/354; 362/370; and 378/386.

8. The ADC of claim 1, wherein the cytotoxic agent is selected from an auristatin, a maytansinoid, a tubulysin, a tomaymycin, or a dolastatin.

9. The ADC of claim 1, wherein the cytotoxic agent is an auristatin selected from MMAE or MMAF, or a maytansinoid selected from DM1 or DM4.

10. The ADC of claim 1, wherein the cytotoxic agent is a maytansinoid having the structure of:

[Chemical structure]

wherein A is arylene or heteroarylene; or

[Chemical structure]

wherein:
A$_{3a}$ is an amino acid, a peptide having 2-20 amino acids, an alkyl, an alkynyl, an alkenyl, a cycloalkyl, an aryl, a heteroaryl, a heterocyclyl, —CR$_5$R$_6$—, —O—, —C(=O)—, —O—C(=O)—, —C(=O)—O—, —O—C(=O)—O—, —C(=O)—(CH$_x$)$_{p1}$—, —C(=O)—O—(CH$_x$)$_{p1}$—, —(CH$_x$)$_{p1}$—C(=O)—, —(CH$_x$)$_{p1}$—C(=O)—O—, —(O—(CH$_2$)$_{p2}$—)$_{p3}$—, —((CH$_2$)$_{p2}$—O—)$_{p3}$—, —C(=S)—, —C(=S)—S—, —C(=S)—NH—, —S—C(=S)—, —S—C(=S)—S—, —S—, —SO—, —SO$_2$—, —NR$_4$—, —N(R$_4$)—C(=O)—N(R$_8$)—, —N(R$_4$)—C(=O)O—, —N(R$_4$)—C(=O)—, —C(=O)—N(R$_4$)—, —C(=O)—N(R$_4$)—C(=O)—, or —O—C(=O)—NR$_4$—, wherein alkyl, alkynyl, alkenyl, cycloalkyl, aryl, heteroaryl, and heterocyclyl are optionally substituted; and p1, p2 and p3 are each independently 0, or an integer from 1 to 100;

x is 0, 1 or 2;

R$_4$, R$_5$, R$_6$ and R$_8$ are each independently H, or a substituted or unsubstituted: alkyl, alkenyl, alkynyl, aryl, heteroaryl, or heterocyclyl; and R$_{4a}$ is a substituted or unsubstituted: alkyl, alkenyl, alkynyl, aryl, heteroaryl, or heterocyclyl.

11. The ADC of claim 10, wherein the maytansinoid is:

[Chemical structure]

12. The ADC of claim 10, wherein the maytansinoid is:

[Chemical structure]

13. The ADC of claim 1, comprising an anti-STEAP2 antibody or fragment thereof, and

[Chemical structure]

wherein

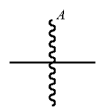

is a bond to the anti-STEAP2 antibody or fragment thereof.

14. The ADC of claim 1, comprising an anti-STEAP2 antibody or fragment thereof, and

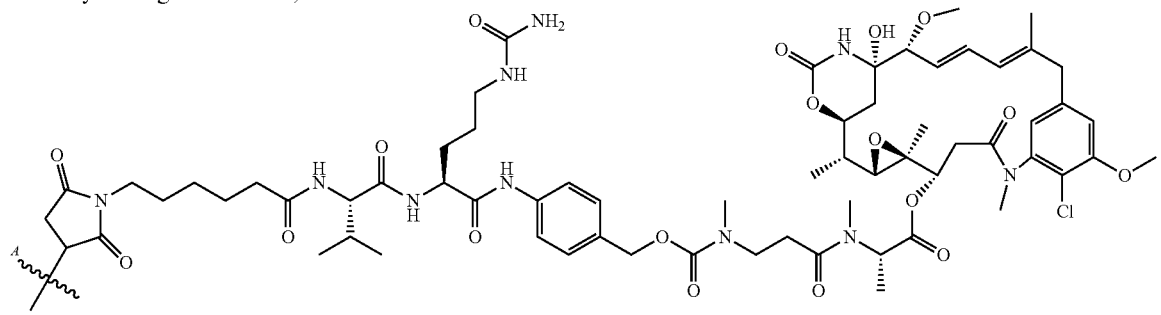

wherein

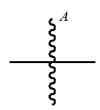

is a bond to the anti-STEAP2 antibody or fragment thereof.

15. The ADC of claim 1, comprising an anti-STEAP2 antibody or fragment thereof, and

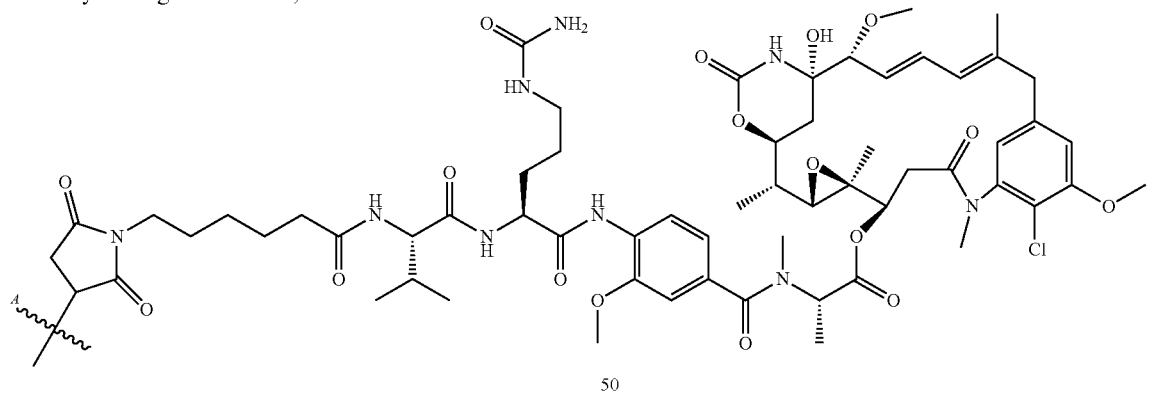

wherein

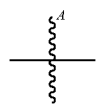

is a bond to the anti-STEAP2 antibody or fragment thereof.

16. The ADC of claim 13, wherein the bond contacts the antibody or fragment thereof via a sulfur constituent of a cysteine residue.

17. The ADC of claim 1, comprising an anti-STEAP2 antibody or fragment thereof, and

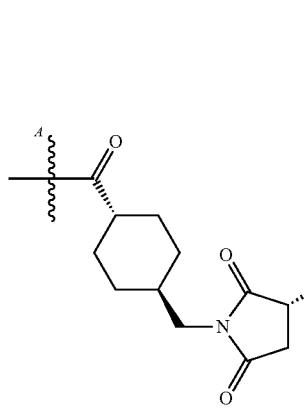
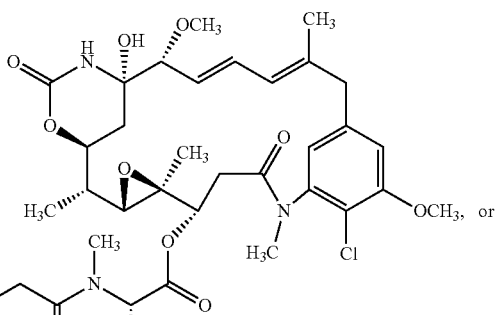

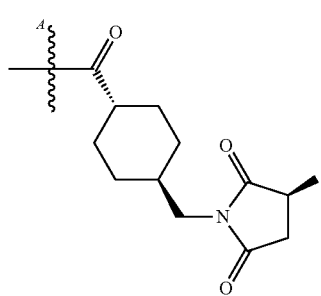

or
a mixture thereof,
wherein

is a bond to the anti-STEAP2 antibody or fragment thereof.

18. The ADC of claim 17, wherein the bond contacts the antibody or fragment thereof via a nitrogen constituent of a lysine residue.

19. The ADC of claim 1, wherein the ADC comprises 1 to 4 cytotoxic agents per anti-STEAP2 antibody or fragment thereof.

20. A pharmaceutical composition comprising the antibody-drug conjugate of claim 1, and a pharmaceutically acceptable carrier or diluent.

21. A method for treating a cancer in a subject, the method comprising administering to the subject the pharmaceutical composition of claim 20.

22. The ADC of claim 10, wherein the maytansinoid is:

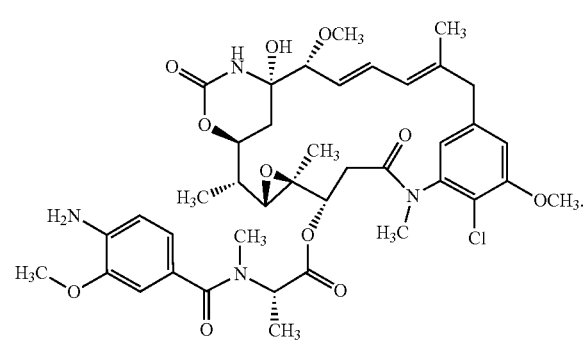 [SMILES: COc1cc(C(=O)N(C)[C@@H](C)C(=O)O[C@H]2CC(=O)N(C)c3cc(cc(OC)c3Cl)C/C(C)=C/C=C/[C@@H](OC)[C@@]3(O)C[C@H](OC(=O)N3)[C@@H](C)[C@@H]3O[C@@]23C)ccc1N]

23. The ADC of claim 1, wherein the anti-STEAP2 antibody or antigen-binding fragment comprises HCDR1-HCDR2-HCDR3-LCDR1-LCDR2-LCDR3 domains, respectively, comprising the amino acid sequences of SEQ ID NOs: 220-222-224-228-230-232.

24. The ADC of claim 1, wherein the anti-STEAP2 antibody or antigen-binding fragment comprises a heavy chain variable region (HCVR) comprising the amino acid sequence of SEQ ID NO: 218, and a light chain variable region (LCVR) comprising the amino acid sequence of SEQ ID NO: 226.

25. The ADC of claim 1, wherein the anti-STEAP2 antibody or antigen-binding fragment comprises the CDRs of a HCVR comprising the amino acid sequence of SEQ ID NO: 218, and the CDRs of a LCVR comprising the amino acid sequence of SEQ ID NO: 226.

26. The ADC of claim 23, wherein the cytotoxic agent is selected from an auristatin, a maytansinoid, a tubulysin, a tomaymycin, or a dolastatin.

27. The ADC of claim 23, wherein the cytotoxic agent is an auristatin selected from MMAE or MMAF, or a maytansinoid selected from DM1 or DM4.

28. A pharmaceutical composition comprising the antibody-drug conjugate of claim 23, and a pharmaceutically acceptable carrier or diluent.

29. A method for treating a cancer in a subject, the method comprising administering to the subject the pharmaceutical composition of claim 28.

30. The ADC of claim 24, wherein the cytotoxic agent is selected from an auristatin, a maytansinoid, a tubulysin, a tomaymycin, or a dolastatin.

31. The ADC of claim 24, wherein the cytotoxic agent is an auristatin selected from MMAE or MMAF, or a maytansinoid selected from DM1 or DM4.

32. A pharmaceutical composition comprising the antibody-drug conjugate of claim 24, and a pharmaceutically acceptable carrier or diluent.

33. A method for treating a cancer in a subject, the method comprising administering to the subject the pharmaceutical composition of claim 32.

34. The ADC of claim 23, wherein the cytotoxic agent is:

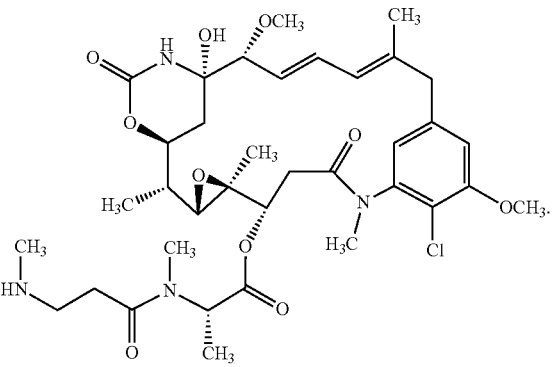 [SMILES: CNCCC(=O)N(C)[C@@H](C)C(=O)O[C@H]1CC(=O)N(C)c2cc(cc(OC)c2Cl)C/C(C)=C/C=C/[C@@H](OC)[C@@]2(O)C[C@H](OC(=O)N2)[C@@H](C)[C@@H]2O[C@@]12C]

35. The ADC of claim 23, wherein the cytotoxic agent is:

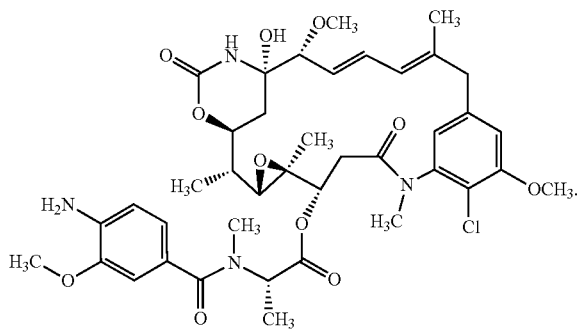 [SMILES: COc1cc(C(=O)N(C)[C@@H](C)C(=O)O[C@H]2CC(=O)N(C)c3cc(cc(OC)c3Cl)C/C(C)=C/C=C/[C@@H](OC)[C@@]3(O)C[C@H](OC(=O)N3)[C@@H](C)[C@@H]3O[C@@]23C)ccc1N]

36. The ADC of claim 23, wherein the anti-STEAP2 antibody or antigen-binding fragment is conjugated to:

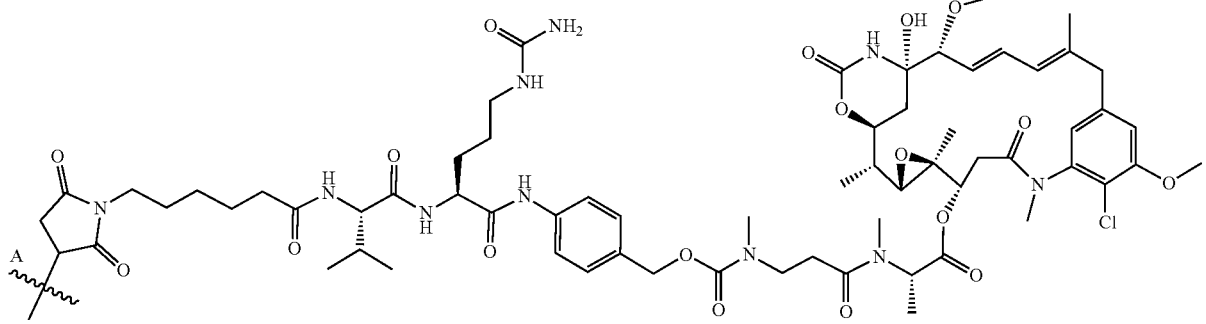

wherein

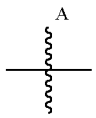

is a bond to the anti-STEAP2 antibody or fragment thereof.

37. The ADC of claim 23, wherein the anti-STEAP2 antibody or antigen-binding fragment is conjugated to:

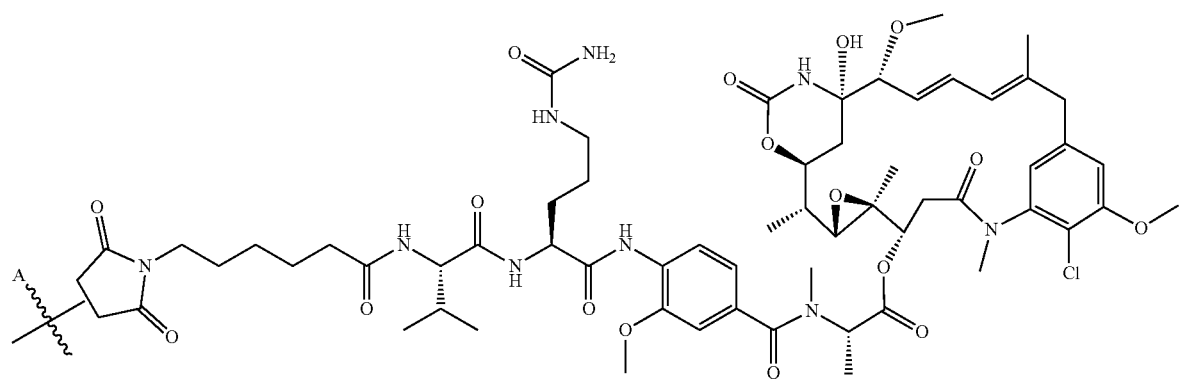
wherein
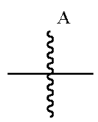
is a bond to the anti-STEAP2 antibody or fragment thereof.
38. The ADC of claim 24, wherein the cytotoxic agent is:
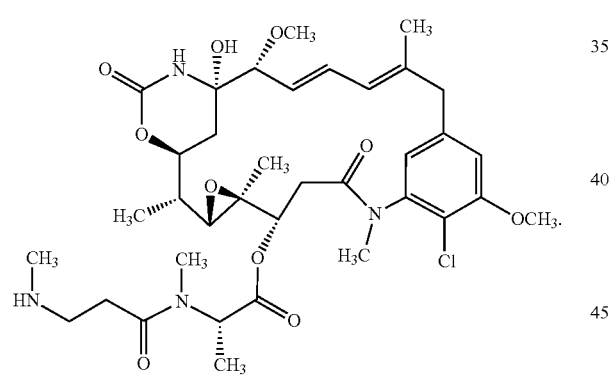
39. The ADC of claim 24, wherein the cytotoxic agent is:
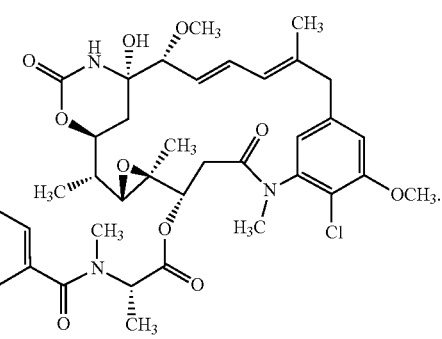
40. The ADC of claim 24, wherein the anti-STEAP2 antibody or antigen-binding fragment is conjugated to:
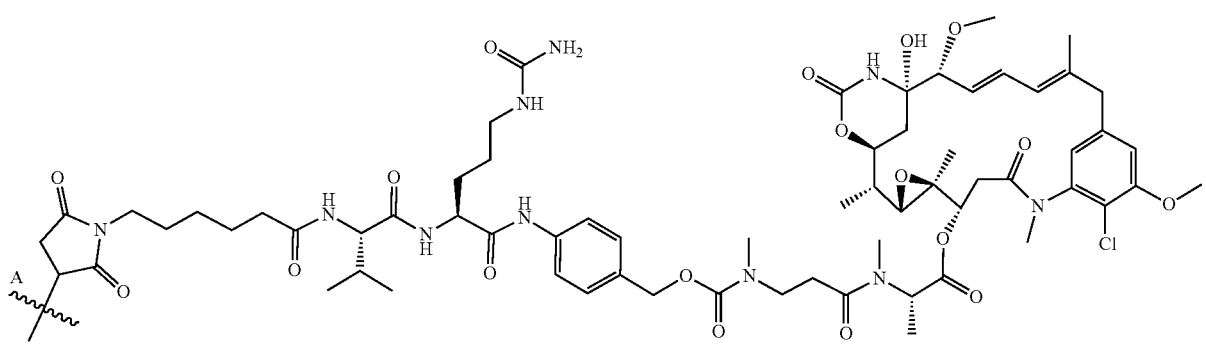

wherein
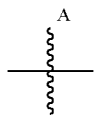
is a bond to the anti-STEAP2 antibody or fragment thereof.
41. The ADC of claim 24, wherein the anti-STEAP2 antibody or antigen-binding fragment is conjugated to:
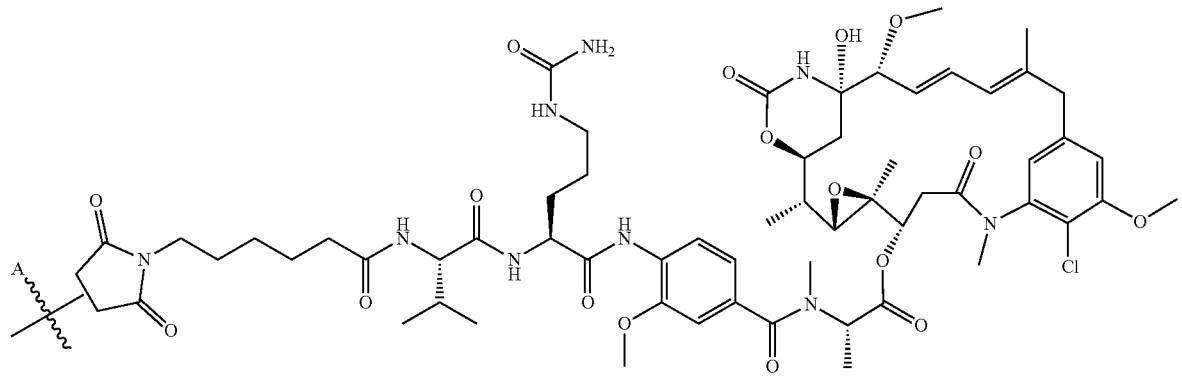
wherein
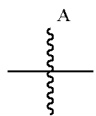
is a bond to the anti-STEAP2 antibody or fragment thereof.
* * * * *